United States Patent
Bhattacharyya

(10) Patent No.: US 7,256,323 B1
(45) Date of Patent: Aug. 14, 2007

(54) RPSK-1 GENE FAMILY, NUCLEOTIDE SEQUENCES AND USES THEREOF

(75) Inventor: Madan K. Bhattacharyya, Ames, IA (US)

(73) Assignee: Iowa State University Research Foundation, Inc., Ames, IA (US)

( * ) Notice: Subject to any disclaimer, the term of this patent is extended or adjusted under 35 U.S.C. 154(b) by 0 days.

(21) Appl. No.: 10/909,950

(22) Filed: Aug. 2, 2004

Related U.S. Application Data

(60) Provisional application No. 60/492,169, filed on Aug. 1, 2003.

(51) Int. Cl.
  *C12N 15/09* (2006.01)
  *C12N 15/82* (2006.01)
  *A01H 5/00* (2006.01)

(52) U.S. Cl. .............. 800/279; 800/278; 800/298; 800/295; 435/320.1; 435/468; 536/23.6

(58) Field of Classification Search .............. 800/279, 800/278, 298, 312, 295; 435/320.1, 468, 435/430.1; 536/23.6
See application file for complete search history.

(56) References Cited

U.S. PATENT DOCUMENTS

2004/0237137 A1 * 11/2004 Osumi et al. ............ 800/279

OTHER PUBLICATIONS

Parker et al. The Plant Cell (1996), vol. 8, pp. 2033-2046.*
Lazar et al Mol. Cell. Biol., vol. 8, pp. 1247-1252, 1988.*

* cited by examiner

*Primary Examiner*—Medina A. Ibrahim
(74) *Attorney, Agent, or Firm*—McKee, Voorhees & Sease, P.L.C.

(57) ABSTRACT

This invention relates to the purified and isolated family of Rps1-k disease resistance genes, proteins encoded thereby and use of the same to confer, enhance or otherwise modify resistance of soybean to plant pathogens, particularly *Phytophthora sojae*.

17 Claims, 24 Drawing Sheets
(16 of 24 Drawing Sheet(s) Filed in Color)

A    MAAALVGGAFLSAFLDVVFDRLASPEFVDLIR

B    GKKLSKKLLQKLETTLRVVGAVLDDAEKKQITNTNVKHWLNDLKHAVYEADDLLDHVFTKAATQNKVRDLFSRFSDRKIV
SKLEDIVVTLESHLKLKESLDLKESAVENLSW

C    KAPSTSLEDGSHIYGREKDKEAIIKLLSEDNSDGREVSVVPIVG<u>MGGVGKTTL</u>AQLVYNDENLKQIFDFDFKAWVCVSQE
                                                                                               P loop FDVLKVTKTIIEAVTGKACKLNDLNLLHLELMDKLKDKKF<u>LIVLDDV</u>WTEDYVDWRLLKKPFNRGIIRRSKILLTT<u>RSEK</u>
                                                                          Kinase-2

<u>TAS</u>VVQTVHTYHLNQLSNEDCWSVFANHACLSTESNENTATLEKIGKEIVKKCNGLPLAAESLGGMLRRKHDIGDWNNIL
Kinase-3a
NSDIWELSESECKVIPALRLSYHYLPPHLKRCFVYCSLYPQDYEFEKNELILLWMAEDLLKKPRKGRTLEEVGHEYFDDL
VSRSFFQRS--RTSSWPHRKCFVMHDLMHDLATS D    LGGDFYFRSEELGKETKINTKTRHLSFAKFNSSVLDNFDVIGRAKFLRTFLSIINFEAAPFNNEEAQCIIMSKLM
E        xxLxLxx

| | | |
|---|---|---|
| YL | RVLSFCD | FQSLDSLPDSIGKLI |
| HL | RYLDLSF | SRIETLPKSLCNLY |
| NL | QTLKLCS | CRKLTKLPSDMRNLV |
| NL | RHLGIAY | TPIKEMPRGMGKLN |
| HL | QHLDFFV | VGKHEENGIKELGGLS |
| NL | RGQLEIRK | LENVSQSDEALEARMMDKK |
| HI | NSLQLEW | SGCNNNSTNFQLEIDVLCKLQPHF |
| NI | ESLEIKG | YEGTRFPDWMGNSSYC |
| NM | ISLKLRD | CHNCSMLPSLGQLP |
| SL | KDLGIAR | LNRLKTIDAGFYKNEECRSGTSFP |
| SL | ESLSIDD | MPCWEVWSSFDSEAFP |
| VL | NSLEIRD | CPKLEGSLPNHLP |
| AL | TKLVIRN | CELLVSSLPTAP |
| AI | QSLEICK | SNKVALHAFPL |
| LV | ETIEVEG | SPMVESVIEAITNIQPT |
| CL | RSLTLRD | CSSAVSFPGGRLPE |
| SL | KSLSIKD | LKKLEFPTQHKHE |
| LL | ETLSIES | SCDSLTSLPLVTFP |
| NL | RYLSIEK | CENMEYLLVSGAESFK |
| SL | CYLLIYK | CPNFVSFWREGLPAP |
| NL | ITFSVWG | SDKLKSLPDEMSTLLP |
| KL | EDLTISN | CPEIESFPKRGMPP |
| NL | RRVEIVN | CEKLLSGLAWPSMG |
| ML | THLNVGG | PCDGIKSFPKEGLLPP |
| SL | TSLSLYD | LSNLEMLDCTGLLHLT |
| SL | QQLQIFG | CPKLENMAGESLPF |
| SL | IKLTMVE | CPLLEKRCRMKHPQ |

E    IWPKVSHIPGIKVGNRWI

FIGURE 10 aaagctccatcaacatctctggaagatggatctcatatatatggtagg
K A P S T S L E D G S H I Y G R
gagaaagataaggaggccataatcaagttgttgtcggaggataacagtgacggtagagaa
E K D K E A I I K L L S E D N S D G R E
gtgtctgtggttcctattgtgggcatgggtggggttggaaaaactactttggcccaattg
V S V V P I V G M G G V G K T T L A Q L
gtgtacaacgatgagaatttgaaacagatatttgattttgattttaaggcatgggtttgt
V Y N D E N L K Q I F D F D F K A W V C
gtttctcaagaatttgatgttctcaaggtcacaaaaactataatagaggcggtgactgga
V S Q E F D V L K V T K T I I E A V T G
aaggcttgtaaattgaatgatctgaatctacttcatcttgaattgatggacaagctgaaa
K A C K L N D L N L L H L E L M D K L K
gataaaaaattcttaattgttttggatgatgtttggacagaggattatgttgattggcgt
D K K F L I V L D D V W T E D Y V D W R
cttcttaagaaaccatttaaccgtgggattattaggagaagtaaaattcttctaacaacc
L L K K P F N R G I I R R S K I L L T T
cgcagtgaaaaaacagcatctgtagtccaaactgttcacacctatcatctaaaccaattg
R S E K T A S V V Q T V H T Y H L N Q L
tcgaatgaagattgttggtcagtgtttgcgaaccatgcatgtctttccacggaatctaac
S N E D C W S V F A N H A C L S T E S N
gagaacacagcaacactagaaaaaattggaaaggagattgttaaaaagtgcaacggactg
E N T A T L E K I G K E I V K K C N G L
cctttagcagcagagtcgcttggaggcatgttgagaagaaagcatgacattggtgattgg
P L A A E S L G G M L R R K H D I G D W
aataatattctcaatagtgacatttgggaactttctgaaagtgagtgtaaagttattcca
N N I L N S D I W E L S E S E C K V I P
gcactgagacttagttatcattatctccctccacatttaaaacgatgctttgtttattgt
A L R L S Y H Y L P P H L K R C F V Y C
tcgttgtatccacaagattacgaatttgaaaaaaatgaattaatcttgttgtggatggct
S L Y P Q D Y E F E K N E L I L L W M A
gaagatcttttgaagaaaccaaggaaaggtaggactttagaagaggttggtcatgagtat
E D L L K K P R K G R T L E E V G H E Y
tttgatgatttggtttcgagatcgttttccaacgttcaagaacaagtagttggcctcat
F D D L V S R S F F Q R S R T S S W P H
cgcaaatgttttgtgatgcatgacctcatgcatgatctagccacatca     (SEQ ID NO:70)
R K C F V M H D L M H D L A T S     (SEQ ID NO:71)

FIGURE 15B

RPSK-1 GENE FAMILY, NUCLEOTIDE SEQUENCES AND USES THEREOF

GRANT REFERENCE

Work for this invention was funded in part by a grant from the United States Government, USDA/CSREES Contracts 2002-31100-06019, 2001-31100-06019, and 2001-35301-10577. The Government may have certain rights in this invention.

CROSS-REFERENCE TO RELATED APPLICATIONS

This application is a conversion of U.S. Provisional Application No. 60/492,169, filed Aug. 1, 2003, which is herein incorporated by reference in its entirety.

FIELD OF THE INVENTION

This invention relates to the purified and isolated family of Rps1-k disease resistance genes, proteins encoded thereby and use of the same to confer, enhance or otherwise modify resistance of soybean to plant pathogens, particularly *Phytophthora sojae*.

BACKGROUND OF THE INVENTION

Soybean [*Glycine max* L. (Merrill)] is a major oil seed crop and is grown throughout much of the world. The United States alone produces over half of the world output. Soybean seed typically contains 40% protein and 20% oil and is used primarily for livestock feed and industrial purposes, in addition to human consumption. In North America, soybean suffers yield loss from the root and stem rot disease caused by oomycete pathogen *Phytophthora sojae*. In the United States the annual crop losses from this disease were valued to about 0.2–0.3 billion dollars (Wrather et al. 2001). Plant resistance to this and other sort of pathogens present a major problem to soybean growers.

Plant do not have circulatory or any auto-immune systems that are integral parts of mammalian defenses to pathogens and instead have evolved unique defense mechanisms to defeat invading pathogenic organisms. Plants rely primarily on active defense mechanisms to combat and resist damage from invading pathogens. These defense mechanisms are regulated by single race-specific disease resistance (R) genes that encode receptors to recognize specific pathogen derived ligand molecules (Dangl and Jones 2001). The genetic basis of this recognition phenomenon was described by Flor as a 'gene for gene' relationship in the flax and *Melampsora lini* interaction (Flor 1955). In recent years over 30 R genes have been isolated (Dangl and Jones 2001; Hulbert et al. 2001). Cloning of resistance genes and their corresponding avirulence genes has facilitated the demonstration of the in vivo interactions between products of resistance and avirulence genes as a proof for the Flor's hypothesis (Leister et al. 1996; Scofield et al. 1996; Tang et al. 1996 2000).

Several plant disease resistance genes that follow the classical gene-for-gene hypothesis (Flor, 1955) have been cloned. These genes can be classified into four major groups based on the structures of their protein products: i) proteins with serine/threonine kinase activity, e.g., Pto (Martin et al., 1993); ii) proteins with nucleotide binding sites (NBS) and leucine rich repeat regions (LRR), e.g. RPS2, N, L6, RPM1, Prf, M, I2 and RPP5 (Anderson et al., 1997; Bent et al. 1994; Grant et al., 1995; Lawrence et al., 1995; Mindrinos et al., 1994; Ori et al., 1997; Parker et al., 1997; Salmeron et al., 1996; Whitham et al., 1994); iii) proteins with leucine rich repeat regions and transmembrane domain, e.g. Cf2, Cf4, Cf5, Cf9, and Hs1$^{pro-1}$ (Cai et al., 1997; Dixon et al., 1996; Jones et al., 1994; Thomas et al., 1997) and iv) proteins with leucine rich repeat regions, transmembrane and serine/threonine kinase domains, e.g. Xa21 (Song et al., 1995). The group carrying genes with NBS and LRR motifs can be sub-divided into two sub-groups. They are: iia) TIR NBS-LRR genes that carry an N-terminal TIR domain with homologies to Toll receptor of *Drosophila* and interleukin-1R receptor of mammals, and iib) non-TIR NBS-LRR genes that carry no TIR domain (Meyers et al., 1999). Most of the disease resistance genes cloned recently belongs to non-TIR group, which includes genes that confer resistance to viruses, bacteria, fungi, oomycetes, nematodes and aphids. TIR NBS-LRR type genes are most likely absent in the Poaceae (Meyers et al., 1999; Pan et al., 2000). Meyers and co-workers (1999) concluded that *Arabidopsis* genome contains approximately 200 genes that encode NBS sequences and are located in 21 genomic clusters and 14 isolated loci. Structural conservation among resistance genes from a wide range of plant species prompted several groups to identify putative resistance genes from *Arabidopsis*, potato, rice, soybean and wheat (Botella et al., 1997; Kanazin et al., 1996; Leister et al., 1998; Leister et al., 1996a; Yu et al., 1996).

Rps (Resistance *Phytophthora sojae*) loci have provided a reasonable protection to soybean crops against *Phytophthora sojae* over the last three decades. There are several physiological races of this fungal pathogen. The number of races is increasing rapidly. For example, in 1994 there were 37 recorded races of the fungus (Förster et al., 1994). Now the number is 45 (Abney et al., 1997). Schmitthenner and his co-workers (1994) concluded that *P. sojae* is a highly variable pathogen and exists in soil as a wide variety of virulence phenotypes to which most Rps genes are ineffective. They also concluded that, unless new Rps genes are identified or existing Rps genes are pyramided in single cultivars, resistance available in the present day cultivars might not be effective in controlling the disease in future.

At present, there are 14 Rps genes that confer race-specific resistance of soybean to different physiological races of *P. sojae*. These genes were obtained from different *Glycine max* lines, and mapped to eight loci (Anderson and Buzzell, 1992; Polzin et al., 1994; Schmitthenner, 1989; Burnham et al. 2003). Of these 14 genes, five are mapped to Rps1 and three to Rps3. The genetics of resistance conferred by Rps genes is well established. Recently, genetics of most of the avirulence genes (Avr) that correspond to specific Rps genes have also been reported (Gijzen et al. 1996; Tyler et al., 1995; Whisson et al., 1994; 1995). The interactions between these 14 Rps genes with the corresponding genes for avirulence in *P. sojae* follow the 'gene-for-gene' hypothesis (Flor, 1955).

To date no soybean resistance gene has been cloned. Lack of these genes has limited the progress towards understanding the signal transduction process involved in the expression of race-specific resistance in soybean. Isolation of this gene will allow us to investigate the mechanism of stable resistance governed by this most extensively used gene.

BRIEF SUMMARY OF THE INVENTION

In one aspect, this invention relates to the family of Rps1-k DNA sequences isolated from soybean (*Glycine max*). Also according to the invention protein sequences are disclosed which are encoded by this family of DNA sequences. These DNA sequences have been found to be highly conserved with 93% to 100% sequence identity and 89.9%–100% identity at the amino acid level. These sequences alone, or in combination with other sequences, can be used to improve the soybean resistance to fungal pathogens such as *Phytophthora*. In another aspect of the present invention, expression cassettes and transformation vectors comprising the isolated nucleotide sequences are disclosed. The transformation vectors can be used to transform plants and express these pathogen control genes in the transformed cells. Further, areas of highly conserved structural regions of these proteins are disclosed which are present throughout the Rps1-k family of genes are disclosed which support that a common signal pathway is involved in mediating resistance in soybean against a diverse group of pathogens including oomycetes, bacteria, ciruses, and nematodes and thus these conserved areas may be used to engineer broad spectrum pathogen resistance. Transformed cells as well as regenerated transgenic plants and seeds containing and expressing the isolated DNA sequences and protein products are also provided.

Therefore, in one aspect, the present invention relates to an isolated nucleic acid comprising an isolated polynucleotide sequence encoding a Rps1-k gene product. In a further aspect, the present invention includes a nucleic acid selected from: (a) an isolated polynucleotide encoding a polypeptide of the present invention; (b) a polynucleotide having at least 90% or 95% identity to a polynucleotide of the present invention; (c) a polynucleotide comprising at least 50 or more nucleotides in length which hybridizes under high stringency conditions to a polynucleotide of the present invention; (d) a polynucleotide comprising a polynucleotide of the present invention; and (e) a polynucleotide which is complementary to the polynucleotide of (a) to (e). The invention also relates a polynucleotide which encodes a series of conserved structural motifs known to be associated with pathogen resistance and found to be present in all Rps1-k family members.

In another aspect, the present invention relates to a recombinant expression cassette comprising a nucleic acid as described, supra. Additionally, the present invention relates to a vector containing the recombinant expression cassette. Further, the vector containing the recombinant expression cassette can facilitate the transcription and translation of the nucleic acid in a host cell. The present invention also relates to host cells able to express the polynucleotide of the present invention. A number of host cells could be used, such as but not limited to, microbial, mammalian, plant, or insect. Thus the invention is also directed to transgenic cells, containing the nucleic acids of the present invention as well as cells, plants, tissue cultures and ultimately lines derived therefrom.

This invention also provides an isolated polypeptide comprising (a) a polypeptide comprising at least 90% or 95% sequence identity to a polypeptide of the present invention (b) a polypeptide encoded by a nucleic acid of the present invention; and (c) a polypeptide comprising Rps1-k activity and comprising the conserved structural domain motifs of the invention.

Another embodiment of the subject invention comprises a methods for engineering broad spectrum pathogen resistance in soybean plants using Rps1-k proteins against *Phytophthora* and other soybean pathogens by elucidating the pathways that regulate gene transcription involved in enhancing accumulation of products shown to be associated with expression of pathogen resistance, methods for providing for increased non specific resistance to particularly virulent races or strains of pathogenic agents including *P. sojae, Pseudomonas syringae* pv. *glycenia* (Psg), soybean cyst nematode (SCN), or soybean mosaic virus.

Nucleotide sequences isolated from the Rps1-k locus including the Rps1-k gene family can be used in developing perfect molecular markers that can be routinely used in breeding programs for incorporating Rps1-k and four other functional Rps1 genes such as Rps1-a, -b, -c and -d into new soybean cultivars.

The Rps1-k gene family will pave the way for better understanding the mechanism of *Phytophthora* resistance and also for isolating other important proteins involved in the expression of resistance, and thereby, this invention will lead to the development of a strong background for genetic engineering of soybean for disease resistance.

Definitions

Units, prefixes, and symbols may be denoted in their SI accepted form. Unless otherwise indicated, nucleic acids are written left to right in 5' to 3' orientation; amino acid sequences are written left to right in amino to carboxy orientation, respectively. Numeric ranges are inclusive of the numbers defining the range and include each integer within the defined range. Amino acids may be referred to herein by either their commonly known three letter symbols or by the one-letter symbols recommended by the IUPAC-IUB Biochemical nomenclature Commission. Nucleotides, likewise, may be referred to by their commonly accepted single-letter codes. Unless otherwise provided for, software, electrical, and electronics terms as used herein are as defined in The New IEEE Standard Dictionary of Electrical and Electronics Terms ($5^{th}$ edition, 1993). The terms defined below are more fully defined by reference to the specification as a whole.

As used herein the term, "Rps1-k like activity" shall mean that a molecule retains the biological activity of Rps1-k, more particularly that the molecule retains its ability to confer increased or improved resistance to a pathogen such as *Phytophthora* in a plant which expresses the protein as compared to a plant which does not express the protein.

By "amplified" is meant the construction of multiple copies of a nucleic acid sequence or multiple copies complementary to the nucleic acid sequence using at least one of the nucleic acid sequences as a template. Amplification systems include the polymerase chain reaction (PCR) system, ligase chain reaction (LCR) system, nucleic acid sequence based amplification (NASBA, Canteen, Mississauga, Ontario), Q-Beta Replicase systems, transcription-based amplification system (TAS), and strand displacement amplification (SDA). See, e.g., *Diagnostic Molecular Microbiology: Principles and Applications*, D. H. Persing et al., Ed., American Society for Microbiology, Washington, D.C. (1993). The product of amplification is termed an amplicon.

As used herein, "chromosomal region" includes reference to a length of a chromosome that may be measured by reference to the linear segment of DNA that it comprises. The chromosomal region can be defined by reference to two unique DNA sequences, i.e., markers.

The term "conservatively modified variants" applies to both amino acid and nucleic acid sequences. With respect to particular nucleic acid sequences, conservatively modified variants refers to those nucleic acids which encode identical or conservatively modified variants of the amino acid sequences. Because of the degeneracy of the genetic code, a large number of functionally identical nucleic acids encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations" and represent one species of conservatively modified variation. Every nucleic acid sequence herein that encodes a polypeptide also, by reference to the genetic code, describes every possible silent variation of the nucleic acid. One of ordinary skill will recognize that each codon in a nucleic acid (except AUG, which is ordinarily the only codon for methionine; and UGG, which is ordinarily the only codon for tryptophan) can be modified to yield a functionally identical molecule. Accordingly, each silent variation of a nucleic acid which encodes a polypeptide of the present invention is implicit in each described polypeptide sequence and is within the scope of the present invention.

As to amino acid sequences, one of skill will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" where the alteration results in the substitution of an amino acid with a chemically similar amino acid. Thus, any number of amino acid residues selected from the group of integers consisting of from 1 to 15 can be so altered. Thus, for example, 1, 2, 3, 4, 5, 7, or 10 alterations can be made. Conservatively modified variants typically provide similar biological activity as the unmodified polypeptide sequence from which they are derived. For example, substrate specificity, enzyme activity, or ligand/receptor binding is generally at least 30%, 40%, 50%, 60%, 70%, 80%, or 90% of the native protein for its native substrate. Conservative substitution tables providing functionally similar amino acids are well known in the art.

The following six groups each contain amino acids that are conservative substitutions for one another:

1) Alanine (A), Serine (S), Threonine (T);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V); and
6) Phenylalanine (F), Tyrosine (Y), Tryptophan (W).

See also, Creighton (1984) Proteins W.H. Freeman and Company.

By "encoding" or "encoded", with respect to a specified nucleic acid, is meant comprising the information for translation into the specified protein. A nucleic acid encoding a protein may comprise non-translated sequences (e.g., introns) within translated regions of the nucleic acid, or may lack such intervening non-translated sequences (e.g., as in cDNA). The information by which a protein is encoded is specified by the use of codons. Typically, the amino acid sequence is encoded by the nucleic acid using the "universal" genetic code. However, variants of the universal code, such as are present in some plant, animal, and fungal mitochondria, the bacterium *Mycoplasma capricolum*, or the ciliate *Macronucleus*, may be used when the nucleic acid is expressed therein.

When the nucleic acid is prepared or altered synthetically, advantage can be taken of known codon preferences of the intended host where the nucleic acid is to be expressed. For example, although nucleic acid sequences of the present invention may be expressed in both monocotyledonous and dicotyledonous plant species, sequences can be modified to account for the specific codon preferences and GC content preferences of monocotyledons or dicotyledons as these preferences have been shown to differ (Murray et al. *Nucl. Acids Res.* 17:477–498 (1989)). Thus, the maize preferred codon for a particular amino acid may be derived from known gene sequences from maize. Maize codon usage for 28 genes from maize plants are listed in Table 4 of Murray et al., supra.

As used herein "full-length sequence" in reference to a specified polynucleotide or its encoded protein means having the entire amino acid sequence of, a native (non-synthetic), endogenous, biologically active form of the specified protein. Methods to determine whether a sequence is full-length are well known in the art including such exemplary techniques as northern or western blots, primer extensions, S1 protection, and ribonuclease protection. See, e.g., *Plant Molecular Biology: A Laboratory Manual*, Clark, Ed., Springer-Verlag, Berlin (1997). Comparison to known full-length homologous (orthologous and/or paralogous) sequences can also be used to identify full-length sequences of the present invention. Additionally, consensus sequences typically present at the 5' and 3' untranslated regions of mRNA aid in the identification of a polynucleotide as full-length. For example, the consensus sequence ANNNN<u>AUG</u>G, where the underlined codon represents the N-terminal methionine, aids in determining whether the polynucleotide has a complete 5' end. Consensus sequences at the 3' end, such as polyadenylation sequences, aid in determining whether the polynucleotide has a complete 3' end.

As used herein, "heterologous" in reference to a nucleic acid is a nucleic acid that originates from a foreign species, or, if from the same species, is substantially modified from its native form in composition and/or genomic locus by deliberate human intervention. For example, a promoter operably linked to a heterologous structural gene is from a species different from that from which the structural gene was derived, or, if from the same species, one or both are substantially modified from their original form. A heterologous protein may originate from a foreign species or, if from the same species, is substantially modified from its original form by deliberate human intervention.

By "host cell" is meant a cell which contains a vector and supports the replication and/or expression of the vector. Host cells may be prokaryotic cells such as *E. coli*, or eukaryotic cells such as yeast, insect, amphibian, or mammalian cells. Preferably, host cells are monocotyledonous or dicotyledonous plant cells. A particularly preferred monocotyledonous host cell is a maize host cell.

The term "hybridization complex" includes reference to a duplex nucleic acid structure formed by two single-stranded nucleic acid sequences selectively hybridized with each other.

The term "introduced" in the context of inserting a nucleic acid into a cell, means "transfection" or "transformation" or "transduction" and includes reference to the incorporation of a nucleic acid into a eukaryotic or prokaryotic cell where the nucleic acid may be incorporated into the genome of the cell (e.g., chromosome, plasmid, plastid or mitochondrial DNA), converted into an autonomous replicon, or transiently expressed (e.g., transfected mRNA).

The term "isolated" refers to material, such as a nucleic acid or a protein, which is: (1) substantially or essentially free from components that normally accompany or interact with it as found in its naturally occurring environment. The isolated material optionally comprises material not found with the material in its natural environment; or (2) if the material is in its natural environment, the material has been synthetically (non-naturally) altered by deliberate human intervention to a composition and/or placed at a location in the cell (e.g., genome or subcellular organelle) not native to a material found in that environment. The alteration to yield the synthetic material can be performed on the material within or removed from its natural state. For example, a naturally occurring nucleic acid becomes an isolated nucleic acid if it is altered, or if it is transcribed from DNA which has been altered, by means of human intervention performed within the cell from which it originates. See, e.g., Compounds and Methods for Site Directed Mutagenesis in Eukaryotic Cells, Kmiec, U.S. Pat. No. 5,565,350; In Vivo Homologous Sequence Targeting in Eukaryotic Cells; Zarling et al., PCT/US93/03868. Likewise, a naturally occurring nucleic acid (e.g., a promoter) becomes isolated if it is introduced by non-naturally occurring means to a locus of the genome not native to that nucleic acid. Nucleic acids which are "isolated" as defined herein, are also referred to as "heterologous" nucleic acids.

As used herein, "localized within the chromosomal region defined by and including" with respect to particular markers includes reference to a contiguous length of a chromosome delimited by and including the stated markers.

As used herein, "marker" includes reference to a locus on a chromosome that serves to identify a unique position on the chromosome. A "polymorphic marker" includes reference to a marker which appears in multiple forms (alleles) such that different forms of the marker, when they are present in a homologous pair, allow transmission of each of the chromosomes of that pair to be followed. A genotype may be defined by use of one or a plurality of markers.

As used herein, "nucleic acid" includes reference to a deoxyribonucleotide or ribonucleotide polymer in either single- or double-stranded form, and unless otherwise limited, encompasses known analogues having the essential nature of natural nucleotides in that they hybridize to single-stranded nucleic acids in a manner similar to naturally occurring nucleotides (e.g., peptide nucleic acids).

By "nucleic acid library" is meant a collection of isolated DNA or cDNA molecules which comprise and substantially represent the entire transcribed fraction of a genome of a specified organism. Construction of exemplary nucleic acid libraries, such as genomic and cDNA libraries, is taught in standard molecular biology references such as Berger and Kimmel, *Guide to Molecular Cloning Techniques, Methods in Enzymology*, Vol. 152, Academic Press, Inc., San Diego, Calif. (Berger); Sambrook et al., *Molecular Cloning—A Laboratory Manual*, $2^{nd}$ ed., Vol. 1–3 (1989); and *Current Protocols in Molecular Biology*, F. M. Ausubel et al., Eds., Current Protocols, a joint venture between Greene Publishing Associates, Inc. and John Wiley & Sons, Inc. (1994).

As used herein "operably linked" includes reference t a functional linkage between a promoter and a second sequence, wherein the promoter sequence initiates and mediates transcription of the DNA sequence corresponding to the second sequence. Generally, operably linked means that the nucleic acid sequences being linked are contiguous and, where necessary to join two protein coding regions, contiguous and in the same reading frame.

As used herein, the term "plant" can include reference to whole plants, plant parts or organs (e.g., leaves, stems, roots, etc.), plant cells, seeds and progeny of same. Plant cell, as used herein, further includes, without limitation, cells obtained from or found in: seeds, suspension cultures, embryos, meristematic regions, callus tissue, leaves, roots, shoots, gametophytes, sporophytes, pollen, and microspores. Plant cells can also be understood to include modified cells, such as protoplasts, obtained from the aforementioned tissues. The class of plants which can be used in the methods of the invention is generally as broad as the class of higher plants amenable to transformation techniques, including both monocotyledonous and dicotyledonous plants. Particularly preferred plants include maize, soybean, sunflower, sorghum, canola, wheat, alfalfa, cotton, rice, barley, and millet.

As used herein, "polynucleotide" includes reference to a deoxyribopolynucleotide, ribopolynucleotide, or analogs thereof that have the essential nature of a natural ribonucleotide in that they hybridize, under stringent hybridization conditions, to substantially the same nucleotide sequence as naturally occurring nucleotides and/or allow translation into the same amino acid(s) as the naturally occurring nucleotide(s). A polynucleotide can be full-length or a subsequence of a native or heterologous structural or regulatory gene. Unless otherwise indicated, the term includes reference to the specified sequence as well as the complementary sequence thereof. Thus, DNAs or RNAs with backbones modified for stability or for other reasons as "polynucleotides" as that term is intended herein. Moreover, DNAs or RNAs comprising unusual bases, such as inosine, or modified bases, such as tritylated bases, to name just two examples, are polynucleotides as the term is used herein. It will be appreciated that a great variety of modifications have been made to DNA and RNA that serve many useful purposes known to those of skill in the art. The term polynucleotide as it is employed herein embraces such chemically, enzymatically or metabolically modified forms of polynucleotides, as well as the chemical forms of DNA and RNA characteristic of viruses and cells, including among other things, simple and complex cells.

The terms "polypeptide", "peptide" and "protein" are used interchangeably herein to refer to a polymer of amino acid residues. The terms apply to amino acid polymers in which one or more amino acid residue is an artificial chemical analogue of a corresponding naturally occurring amino acid, as well as to naturally occurring amino acid polymers. The essential nature of such analogues of naturally occurring amino acids is that, when incorporated into a protein, that protein is specifically reactive to antibodies elicited to the same protein but consisting entirely of naturally occurring amino acids. The terms "polypeptide", "peptide" and "protein" are also inclusive of modifications including, but not limited to, glycosylation, lipid attachment, sulfation, gamma-carboxylation of glutamic acid residues, hydroxylation and ADP-ribosylation. It will be appreciated, as is well known and as noted above, that polypeptides are not entirely linear. For instance, polypeptides may be branched as a result of ubiquitination, and they may be circular, with or without branching, generally as a result of posttranslation events, including natural processing event and events brought about by human manipulation which do not occur naturally. Circular, branched and branched circular polypeptides may be synthesized by non-translation natural process and by entirely synthetic methods, as well. Further, this invention contemplates the use of both the methionine-containing and the methionine-less amino terminal variants of the protein of the invention.

As used herein "promoter" includes reference to a region of DNA upstream from the start of transcription and involved in recognition and binding of RNA polymerase and other proteins to initiate transcription. A "plant promoter" is a promoter capable of initiating transcription in plant cells whether nor not its origin is a plant cell. Exemplary plant promoters include, but are not limited to, those that are obtained from plants, plant viruses, and bacteria which comprise genes expressed in plant cells such as *Agrobacterium* or *Rhizobium*. Examples of promoters under developmental control include promoters that preferentially initiate transcription in certain tissues, such as leaves, roots, or seeds. Such promoters are referred to as "tissue preferred". Promoters which initiate transcription only in certain tissue are referred to as "tissue specific". A "cell type" specific promoter primarily drives expression in certain cell types in one or more organs, for example, vascular cells in roots or leaves. An "inducible" or "repressible" promoter is a promoter which is under environmental control. Examples of environmental conditions that may effect transcription by inducible promoters include anaerobic conditions or the presence of light. Tissue specific, tissue preferred, cell type specific, and inducible promoters constitute the class of "non-constitutive" promoters. A "constitutive" promoter is a promoter which is active under most environmental conditions.

As used herein "recombinant" includes reference to a cell or vector, that has been modified by the introduction of a heterologous nucleic acid or that the cell is derived from a cell so modified. Thus, for example, recombinant cells express genes that are not found in identical form within the native (non-recombinant) form of the cell or express native genes that are otherwise abnormally expressed, under-expressed or not expressed at all as a result of deliberate human intervention. The term "recombinant" as used herein does not encompass the alteration of the cell or vector by naturally occurring events (e.g., spontaneous mutation, natural transformation/transduction/transposition) such as those occurring without deliberate human intervention.

As used herein, a "recombinant expression cassette" is a nucleic acid construct, generated recombinantly or synthetically, with a series of specified nucleic acid elements which permit transcription of a particular nucleic acid in a host cell. The recombinant expression cassette can be incorporated into a plasmid, chromosome, mitochondrial DNA, plastid DNA, virus, or nucleic acid fragment. Typically, the recombinant expression cassette portion of an expression vector includes, among other sequences, a nucleic acid to be transcribed, and a promoter.

The term "residue" or "amino acid residue" or "amino acid" are used interchangeably herein to refer to an amino acid that is incorporated into a protein, polypeptide, or peptide (collectively "protein"). The amino acid may be a naturally occurring amino acid and, unless otherwise limited, may encompass non-natural analogs of natural amino acids that can function in a similar manner as naturally occurring amino acids.

The term "selectively hybridizes" includes reference to hybridization, under stringent hybridization conditions, of a nucleic acid sequence to a specified nucleic acid target sequence to a detectably greater degree (e.g., at least 2-fold over background) than its hybridization to non-target nucleic acid sequences and to the substantial exclusion of non-target nucleic acids. Selectively hybridizing sequences typically have about at least 80% sequence identity, preferably 90% sequence identity, and most preferably 100% sequence identity (i.e., complementary) with each other.

The term "stringent conditions" or "stringent hybridization conditions" includes reference to conditions under which a probe will hybridize to its target sequence, to a detectably greater degree than to other sequences (e.g., at least 2-fold over background). Stringent conditions are sequence-dependent and be different in different circumstances. By controlling the stringency of the hybridization and/or washing conditions, target sequences can be identified which are 100% complementary to the probe (homologous probing). Alternatively, stringency conditions can be adjusted to allow some mismatching in sequences so that lower degrees of similarity are detected (heterologous probing). Generally, a probe is less than about 1000 nucleotides in length, optionally less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1 M NaCl, 1% SDS at 37° C., and a wash in 0.5× to 1×SSC at 55 to 50° C. Exemplary high stringency conditions include hybridization in 50% formamide, 1 M NaCl, 1% SDS at 37° C., and a wash in 0.1×SSC at 60 to 65° C.

Specificity is typically the function of post-hybridization washes, the critical factors being the ionic strength and temperature of the final wash solution. For DNA—DNA hybrids, the $T_m$ can be approximated from the equation of Meinkoth and Wahl, *Anal. Biochem.*, 138:267–284 (1984): $T_m=81.5°$ C.$+16.6$ (log M)$+0.41$ (% GC)$-0.61$ (% form)$-500/L$; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of the complementary target sequence hybridizes to a perfectly matched probe. $T_m$ is reduced by about 1° C. for each 1% of mismatching; thus, $T_m$, hybridization and/or wash conditions can be adjusted to hybridize to sequences of the desired identity. For example, if sequences with $\geq 90\%$ identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution) it is preferred to increase the SSC concentration so that a higher temperature can be used. An extensive guide to the hybridization of nucleic acids is found in Tijssen, *Laboratory Techniques in Biochemistry and Molecular Biology—Hybridization with Nucleic Acids Probes*, Part I, Chapter 2, Ausubel, et al., Eds., Greene Publishing and Wiley-Interscience, New York (1995). In general a high stringency wash is 2×15 min in 0.5×SSC containing 0.1% SDS at 65° C.

As used herein, "transgenic plant" includes reference to a plant which comprises within its genome a heterologous polynucleotide. Generally, the heterologous polynucleotide is stably integrated within the genome such that the polynucleotide is passed on to successive generations. The heterologous polynucleotide may be integrated into the genome alone or as part of a recombinant expression cassette. "Transgenic" is used herein to include any cell, cell line, callus, tissue, plant part or plant, the genotype of which has been altered by the presence of heterologous nucleic acid including those transgenics initially so altered as well as those created by sexual crosses or asexual propagation from the initial transgenic. The term "transgenic" as used herein does not encompass the alteration of the genome (chromosomal or extra-chromosomal) by conventional plant breeding methods or by naturally occurring events such as random cross-fertilization, non-recombinant viral infection, non-recombinant bacterial transformation, non-recombinant transposition, or spontaneous mutation.

As used herein, "vector" includes reference to a nucleic acid used in transfection of a host cell and into which can be inserted a polynucleotide. Vectors are often replicons. Expression vectors permit transcription of a nucleic acid inserted therein.

The following terms are used to describe the sequence relationships between two or more nucleic acids or polynucleotides: (a) "reference sequence", (b) "comparison window", (c) "sequence identity", (d) "percentage of sequence identity", and (e) "substantial identity".

(a) As used herein, "reference sequence" is a defined sequence used as a basis for sequence comparison. A reference sequence may be a subset or the entirety of a specified sequence; for example, as a segment of a full-length cDNA or gene sequence, or the complete cDNA or gene sequence.

(b) As used herein, "comparison window" includes reference to a contiguous and specified segment of a polynucleotide sequence, wherein the polynucleotide sequence may be compared to a reference sequence and wherein the portion of the polynucleotide sequence in the comparison window may comprise additions or deletions (i.e., gaps) compared to the reference sequence (which does not comprise additions or deletions) for optimal alignment of the two sequences. Generally, the comparison window is at least 20 contiguous nucleotides in length, and optionally can be 30, 40, 50, 100, or longer. Those of skill in the art understand that to avoid a high similarity to a reference sequence due to inclusion of gaps in the polynucleotide sequence, a gap penalty is typically introduced and is subtracted from the number of matches.

Methods of alignment of sequences for comparison are well-known in the art. Optimal alignment of sequences for comparison may be conducted by the local homology algorithm of Smith and Waterman, *Adv. Appl. Math.* 2:482 (1981); by the homology alignment algorithm of Needleman and Wunsch, *J. Mol. Biol.* 48:443 (1970); by the search for similarity method of Pearson and Lipman, *Proc. Natl. Acad. Sci.* 85:2444 (1988); by computerized implementations of these algorithms, including, but not limited to: CLUSTAL in the PC/Gene program by Intelligenetics, Mountain View, Calif.; GAP, BESTFIT, BLAST, FASTA, and TFASTA in the Wisconsin Genetics Software Package, Genetics Computer Group (GCG), 575 Science Dr., Madison, Wis., USA; the CLUSTAL program is well described by Higgins and Sharp, *Gene* 73:237–244 (1988); Higgins and Sharp, *CABIOS* 5:151–153 (1989); Corpet, et al., *Nucleic Acids Research* 16:10881–90 (1988); Huang, et al., *Computer Applications in the Biosciences* 8:155–65 (1992), and Pearson, et al., *Methods in Molecular Biology* 24:307–331 (1994). The BLAST family of programs which can be used for database similarity searches includes: BLASTN for nucleotide query sequences against nucleotide database sequences; BLASTX for nucleotide query sequences against protein database sequences; BLASTP for protein query sequences against protein database sequences; TBLASTN for protein query sequences against nucleotide database sequences; and TBLASTX for nucleotide query sequences against nucleotide database sequences. See, *Current Protocols in Molecular Biology*, Chapter 19, Ausubel, et al., Eds., Greene Publishing and Wiley-Interscience, New York (1995).

Unless otherwise stated, sequence identity/similarity values provided herein refer to the value obtained using the BLAST 2.0 suite of programs using default parameters. Altschul et al., *Nucleic Acids Res.* 25:3389–3402 (1997). Software for performing BLAST analyses is publicly available, e.g., through the National Center for Biotechnology-Information (www.hcbi.nlm.nih.gov). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff (1989) *Proc. Natl. Acad. Sci. USA* 89:10915).

In addition to calculating percent sequence identity, the BLAST algorithm also performs a statistical analysis of the similarity between two sequences (see, e.g., Karlin & Altschul, *Proc. Natl. Acad. Sci. USA* 90:5873–5787 (1993)). One measure of similarity provided by the BLAST algorithm is the smallest sum probability (P(N)), which provides an indication of the probability by which a match between two nucleotide or amino acid sequences would occur by chance.

BLAST searches assume that proteins can be modeled as random sequences. However, many real proteins comprise regions of nonrandom sequences which may be homopolymeric tracts, short-period repeats, or regions enriched in one or more amino acids. Such low-complexity regions may be aligned between unrelated proteins even though other regions of the protein are entirely dissimilar. A number of low-complexity filter programs can be employed to reduce such low-complexity alignments. For example, the SEG (Wooten and Federhen, *Comput. Chem.*, 17:149–163

(1993)) and XNU (Claverie and States, *Comput. Chem.*, 17:191–201 (1993)) low-complexity filters can be employed alone or in combination.

(c) As used herein, "sequence identity" or "identity" in the context of two nucleic acid or polypeptide sequences includes reference to the residues in the two sequences which are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are said to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Meyers and Miller, *Computer Applic. Biol. Sci.*, 4:11–17 (1988) e.g., as implemented in the program PC/GENE (Intelligenetics, Mountain View, Calif., USA).

(d) As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

(e) The term "substantial identity" of polynucleotide sequences means that a polynucleotide comprises a sequence that has at least 70% sequence identity, preferably at least 80%, more preferably at least 90% and most preferably at least 95%, compared to a reference sequence using one of the alignment programs described using standard parameters. One of skill will recognize that these values can be appropriately adjusted to determine corresponding identity of proteins encoded by two nucleotide sequences by taking into account codon degeneracy, amino acid similarity, reading frame positioning and the like. Substantial identity of amino acid sequences for these purposes normally means sequence identity of at least 60%, ore preferably at least 70%, 80%, 90%, and most preferably at least 95%.

Another indication that nucleotide sequences are substantially identical is if two molecules hybridize to each other under stringent conditions. However, nucleic acids which do not hybridize to each other under stringent conditions are still substantially identical if the polypeptides which they encode are substantially identical. This may occur, e.g., when a copy of a nucleic acid is created using the maximum codon degeneracy permitted by the genetic code. One indication that two nucleic acid sequences are substantially identical is that the polypeptide which the first nucleic acid encodes is immunologically cross reactive with the polypeptide encoded by the second nucleic acid.

(e) The terms "substantial Identity" in the context of a peptide indicates that a peptide comprises a sequence with at least 70% sequence identity to a reference sequence, preferably 80%, ore preferably 85%, most preferably at least 90% or 95% sequence identity to the reference sequence over a specified comparison window. Optionally, optimal alignment is conducted using the homology alignment algorithm of Needleman and Wunsch, *J. Mol. Biol.* 48:443 (1970). an indication that two peptide sequences are substantially identical is that one peptide is immunologically reactive with antibodies raised against the second peptide. Thus, a peptide is substantially identical to a second peptide, for example, where the two peptides differ only by a conservative substitution. Peptides which are "substantially similar" share sequences as noted above except that residue positions which are not identical may differ by conservative amino acid changes.

The present invention provides, inter alia, compositions and methods for promoting pathogen resistance in plants, more particularly for improving *Phytophthora* resistance of susceptible plants. The compositions of the invention relate to the Rps1-k family of nucleic acid molecules comprising sequences which are known to confer *Phytophthora* resistance in soybeans. These compositions can be transferred into plants to confer or improve *Phytophthora* resistance, modified to engineer gene sequences for broad based non specific resistance in plants, or to isolate and identify other members of the Rps1 family. By "confer or improve *Phytophthora* or other such pathogen resistance" is intended that the proteins or sequences, either alone or in combination with other proteins or sequences, enhance resistance of a plant to *Phytophthora* and *Phytophthora*-caused damage or to other pathogens which cause a similar plant reaction. In this manner, resistance to these fungal pathogens and other pathogens such as *Pseudomonas syringae* pv. *glycinea* (Psg), soybean cyst nematode (SCN), or soybean mosaic virus (SMV) can be enhanced or improved in the transformed plant or its progeny when at least one of the sequences of the invention is provided.

The compositions include nucleic acid molecules comprising sequences of plant genes and the polypeptides encoded thereby. Particularly, the nucleotide and amino acid sequence for the two classes of the Rps1-k family have been isolated. As discussed in more detail below, the sequences of the invention are presumably involved in many basic biochemical pathways that regulate plant pathogen resistance. Thus, methods are provided for the expression of these sequences in a host plant to modulate plant defense responses. Some of the methods involve stably transforming a plant with a nucleotide sequence of the invention operably linked with a promoter capable of driving expression of a gene in a plant cell.

Promoter and other regulatory elements which are natively associated with these genes can be easily isolated using the sequences and methods described herein with no more than routine experimentation. These sequences can also be used to identify promoter, enhancer or other signaling sequences in the regulatory regions of pathogen resistance genes. Such regulatory elements or promoters would provide for temporal and spatial expression of operably linked sequences with pathogen infection in a plant. Nucleotide sequences operably linked to such promoter sequences are transformed into a plant cell. Exposure of the transformed plant to a stimulus such as pathogen infection could induce transcriptional activation of the nucleotide sequences operably linked to these promoter regulatory sequences.

Transformed plants can be obtained having altered or enhanced responses to fungal pathogen attack; hence, the methods and compositions may find uses in altering the response of plants to similar stresses as well. Thus, the sequences of the invention find use in engineering broad-spectrum disease and pest resistance in a variety of plants. A polypeptide is said to have Rps1-k-like activity when it has one or more of the properties of the native protein. It is within the skill in the art to assay protein activities obtained from various sources to determine whether the properties of the proteins are the same. In so doing, one of skill in the art may employ any of a wide array of known assays including, for example, biochemical and/or pathological assays. For example, one of skill in the art could readily produce a plant transformed with a Rps1-k polypeptide variant and assay a property of native Rps1-k protein in that plant material to determine whether a particular Rps1-k property was retained by the variant.

The compositions and methods of the invention are presumably involved in biochemical pathways and as such may also find use in the activation or modulation of expression of other genes, including those involved in other aspects of pathogen response.

Although there is much conservation among these genes, proteins encoded by members of this gene family may contain different elements or motifs or sequence patterns that modulate or affect the activity, subcellular localization, and/or target of the protein in which they are found. For example, one form of Rps1-k was found active only in the roots of soybean plants (Bhattacharyya, unpublished). Such elements, motifs, or sequence patterns may be useful in engineering novel enzymes for modulating gene expression in particular tissues. By "modulating" or "modulation" is intended that the level of expression of a gene may be increased or decreased relative to genes driven by other promoters or relative to the normal or uninduced level of the gene in question.

The present invention provides for isolated nucleic acid molecules comprising nucleotide sequences encoding the amino acid sequence shown in the Figures attached (see examples 2 and 4) and their conservatively modified variants. Further provided are polypeptides having an amino acid sequence encoded by a nucleic acid molecule described herein, for example those polypeptides comprising the sequences set forth in the figures herein, and fragments and variants thereof.

The present invention also provides 6 similar structural domains which were identified to be present in each of the members of the Rps1-kRps1-k family and that have previously been known to be associated with pathogen resistance. Thus the invention comprises proteins which conserved these elements of genes encoding the same which may be optimized for pathogen resistance. According to the invention domain A was found to have a myristylation site, domain B a coiled coil motif, domain C is the putative NBS domain, consisting or a P loop, kinase-2 and kinase-3a motifs. In this region all 11 Pan-defined motifs for CC-NBS-LRR R proteins were observed. Between domain C and E is a short region designated as domain D. Domain E comprises 26 imperfect LRRs. At the beginning of domain E there is a leucine-zipper-like motif. Thus the invention comprises an Rps1-k protein having one or more of the conserved structural domains described herein and which retains Rps1-k-like activity.

The invention encompasses isolated or substantially purified nucleic acid or protein compositions. An "isolated" or "purified" nucleic acid molecule or protein, or biologically active portion thereof, is substantially free of other cellular material, or culture medium when produced by recombinant techniques, or substantially free of chemical precursors or other chemicals when chemically synthesized. In some embodiments, an "isolated" nucleic acid is free of sequences (such as other protein-encoding sequences) that naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kb, 4 kb, 3 kb, 2 kb, 1 kb, 0.5 kb, 0.4 kb, 0.3 kb, 0.2 kb, or 0.1 kb, or 50, 40, 30, 20, or 10 nucleotides that naturally flank the nucleic acid molecule in genomic DNA of the cell from which the nucleic acid is derived. A protein that is substantially free of cellular material includes preparations of protein having less than about 30%, 20%, 10%, 5%, (by dry weight) of contaminating protein. When the protein of the invention or biologically active portion thereof is recombinantly produced, culture medium may represent less than about 30%, 20%, 10%, or 5% (by dry weight) of chemical precursors or non-protein-of-interest chemicals.

Fragments and variants of the disclosed nucleotide sequences are encompassed by the present invention. Fragments and variants of proteins encoded by the disclosed nucleotide sequences are also encompassed by the present invention. By "fragment" is intended a portion of the nucleotide sequence or a portion of the amino acid sequence and hence protein encoded thereby. Fragments of a nucleotide sequence may encode protein fragments that retain the biological activity of the native protein and hence affect development, developmental pathways, stress responses, and/or disease resistance by retaining Rps1-k-like activity. Alternatively, fragments of a nucleotide sequence that are useful as hybridization probes generally do not encode fragment proteins retaining biological activity. Thus, fragments of a nucleotide sequence may range from at least about 20 nucleotides, about 50 nucleotides, about 100 nucleotides, and up to the full-length nucleotide sequence encoding the proteins of the invention.

A fragment of a Rps1-k nucleotide sequence that encodes a biologically active portion of a RPS1k protein of the invention will encode at least 12, 25, 30, 50, 75, etc. contiguous amino acids, or up to the total number of amino acids present in a full-length Rps1-k protein of the invention.

Fragments of an Rps1-k nucleotide sequence that are useful as hybridization probes or PCR primers generally may or may not encode a biologically active portion of a protein. Thus, a fragment of an Rps1-k nucleotide sequence may encode a biologically active portion of an Rps1-k protein, or it may be used as a hybridization probe or PCR primer using methods disclosed below. A biologically active portion of an Rps1-k protein can be prepared by isolating a portion of the Rps1-k nucleotide sequences of the invention, expressing the encoded portion of the Rps1-k protein (e.g., by recombinant expression in vitro), and assessing the activity of the encoded portion of the Rps1-k protein. Nucleic acid molecules that are fragments of an Rps1-k nucleotide sequence comprise at least 16, 20, 25, 30, 40, 50, 60, 70, 80, 90, 100, 125, 150, 175, 200, etc. nucleotides, or up to the number of nucleotides present in a full-length Rps1-k nucleotide sequences disclosed herein.

The proteins of the invention may be altered in various ways including amino acid substitutions, deletions, truncations, and insertions. Methods for such manipulations are generally known in the art. For example, amino acid sequence variants of the Rps1-k proteins can be prepared by mutations in the DNA. Methods for mutagenesis and nucleotide sequence alterations are well known in the art. See, for example, Kunkel (1985) *Proc. Nad. Acad. Sci. USA* 82:488–492; Kunkel et al. (1987) *Methods in Enzymol.* 154:367–382; U.S. Pat. No. 4,873,192; Walker and Gaastra, eds. (1983) *Techniques in Molecular Biology* (MacMillan Publishing Company, New York) and the references cited therein. Guidance as to appropriate amino acid substitutions that do not affect biological activity of the protein of interest may be found in the model of Dayhoff et al. (1978) *Atlas of Protein Sequence and Structure* (Natl. Biomed. Res. Found., Washington, D.C.), herein incorporated by reference. Conservative substitutions, such as exchanging one amino acid with another having similar properties, may be made.

It is recognized that having identified the nucleotide sequences disclosed herein, it is within the state of the art to isolate and identify regulatory elements in the 5' untranslated region upstream from regions defined herein. Thus for example, the promoter regions of the gene sequences disclosed herein may further comprise upstream regulatory elements that confer tissue-preferred expression of heterologous nucleotide sequences operably linked to the disclosed promoter sequence. See particularly, Australian Patent No. AU-A-77751/94 and U.S. Pat. Nos. 5,466,785 and 5,635,618. It is also recognized by those of skill in the art that regulatory elements may be found in transcribed regions of a gene, for example in the region between transcription start and translation start as well as 3' to the end of translation; such elements may be found in the sequences set forth herein.

The nucleotide sequences of the invention can be used to isolate corresponding sequences from other organisms, particularly other plants, more particularly other crop plants. In this manner, methods such as PCR, hybridization, and the like can be used to identify such sequences based on their sequence homology to the sequences set forth herein. Sequences isolated based on their sequence identity to the nucleotide sequences set forth herein or to fragments thereof are encompassed by the present invention. Such sequences include sequences that are orthologs of the disclosed sequences. By "orthologs" is intended genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species. Thus, isolated sequences that have Rps1-k-like activity or and which hybridize under stringent conditions to the Rps1-k sequences disclosed herein, or to fragments thereof, are encompassed by the present invention.

In a PCR approach, oligonucleotide primers can be designed for use in PCR reactions to amplify corresponding DNA sequences from cDNA or genomic DNA extracted from any plant of interest. Methods for designing PCR primers and PCR cloning are generally known in the art and are disclosed in Sambrook et al. (1989) *Molecular Cloning: A Laboratory Manual* (2d ed., Cold Spring Harbor Laboratory Press Plainview, N.Y.). See also Innis et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

In hybridization techniques, all or part of a known nucleotide sequence is used as a probe that selectively hybridizes to other corresponding nucleotide sequences present it a population of cloned genomic DNA fragments or cDNA fragments (i.e., genomic or cDNA libraries) from a chosen organism. The hybridization probes may be genomic DNA fragments, cDNA fragments, RNA fragments, or other oligonucleotides, and may be labeled with a detectable group such as $^{32}P$, or any other detectable marker. Thus, for example, probes for hybridization can be made by labeling synthetic oligonucleotides based on the disease-resistant sequences of the invention. Methods for preparation of probes for hybridization and for construction of cDNA and genomic libraries are generally known in the art and are disclosed in Sambrook et al. (1989) *Molecular Cloning: A Laboratory Manual* (2d ed., Cold Spring Harbor Laboratory Press, Plainview, N.Y.).

For example, an entire sequence disclosed herein, or one or more portions thereof, may be used as a probe capable of specifically hybridizing to corresponding nematode-response sequences, including promoters and messenger RNAs. To achieve specific hybridization under a variety of conditions, such probes include sequences that are unique among nematode-response sequences and may be at least about 10 or 15 or 17 nucleotides in length or at least about 20 or 22 or 25 nucleotides in length. Such probes may be used to amplify corresponding sequences from a chosen organism by PCR. This technique may be used to isolate additional coding sequences from a desired organism or as a diagnostic assay to determine the presence of coding sequences in an organism. Hybridization techniques include hybridization screening of plated DNA libraries (either plaques or colonies; see, for example, Sambrook et al. (1989) *Molecular Cloning: A Laboratory Manual* (2d ed., Cold Spring Harbor Laboratory Press, Plainview, N.Y.).

Assays that measure antipathogenic activity induced by the signal pathway from the sequences herein are commonly known in the art, as are methods to quantitate disease resistance in plants following pathogen infection. See, for example, U.S. Pat. No. 5,614,395, herein incorporated by reference. These assays may be used to measure the activity of the polypeptides of the invention. Such techniques include, measuring over time, the average lesion diameter, the pathogen biomass, and the overall percentage of decayed plant tissues. For example, a plant either expressing an antipathogenic polypeptide or having an antipathogenic composition applied to its surface shows a decrease in tissue necrosis (i.e., lesion diameter) or a decrease in plant death following pathogen challenge when compared to a control plant that was not exposed to the antipathogenic composition. Alternatively, antipathogenic activity can be measured by a decrease in pathogen biomass. For example, a plant expressing an antipathogenic polypeptide or exposed to an antipathogenic composition is challenged with a pathogen of interest. Over time, tissue samples from the pathogen-inoculated tissues are obtained and RNA is extracted. The percent of a specific pathogen RNA transcript relative to the level of a plant specific transcript allows the level of pathogen biomass to be determined. See, for example, Thomma et al. (1998) *Plant Biology* 95:15107–15111, herein incorporated by reference.

Furthermore, in vitro antipathogenic assays include, for example, the addition of varying concentrations of the antipathogenic composition to paper disks and placing the disks on agar containing a suspension of the pathogen of interest. Following incubation, clear inhibition zones develop around the discs that contain an effective concentration of the antipathogenic polypeptide (Liu et al. (1994) *Plant Biology* 91:1888–1892, herein incorporated by reference). Additionally, microspectrophotometrical analysis can be used to measure the in vitro antipathogenic properties of a composition (Hu et al. (1997) *Plant Mol. Biol.* 34:949–959 and Cammue et al. (1992) *J. Biol. Chem.* 267: 2228–2233, both of which are herein incorporated by reference).

Pathogens of the invention include, but are not limited to, fungal and viral pathogens for primarily soybeans which include: *Phytophthora megasperma* fsp. *glycinea*, *Macrophomina phaseolina*, *Rhizoctonia solani*, *Sclerotinia sclerotiorum*, *Fusarium oxysporum*, *Diaporthe phaseolorum* var. *sojae* (*Phomopsis sojae*), *Diaporthe phaseolorum* var. *caulivora*, *Sclerotium rolfsii*, *Cercospora kikuchii*, *Cercospora sojina*, *Peronospora manshurica*, *Colletotrichum dematium* (*Colletotichum truncatum*), *Corynespora cassfcola*, *Septoria glycines*, *Phyllosticta sojicola*, *Alternaria alternata*, *Pseudomonas syringae* p.v. *glycinea*, *Xanthomonas campestris* p.v. *phaseoli*, *Microsphaera diffusa*, *Fusarium semitectum*, *Phialophora gregata*, Soybean mosaic virus, *Glomerella glycines*, Tobacco Ring spot virus, Tobacco Streak virus, *Phakopsora pachyrhizi*, *Pythium aphanidermatum*, *Pythium ultimum*, *Pythium debaryanum*, Tomato spotted wilt virus, *Heterodera glycines*, *Fusarium solani*

It is understood in the art that plant DNA viruses and fungal pathogens remodel the control of the host replication and gene expression machinery to accomplish their own replication and effective infection. The plant response to stress, such as stress caused by *Phytophthora* attack, is known to involve many basic biochemical pathways and cellular functions. Hence, the sequences of the invention may find use in altering the defense mechanisms of a host plant to provide broad-based resistance to disease or insect pests. Additionally, the present invention may be useful in preventing corruption of the cell machinery by viruses and other plant pathogens.

The compositions and methods of the invention function to inhibit or prevent plant diseases. The gene products may accomplish their anti-pathogenic effects by suppressing, controlling, and/or killing the invading pathogenic organism through activation of a signal pathway leading to accumulation of defense compounds.

The cells that have been transformed may be grown into plants in accordance with conventional ways. See, for example, McCormick et al. (1986) *Plant Cell Reports* 5:8184. These plants may then be grown, and either pollinated with the same transformed strain or different strains, and the resulting hybrid having constitutive expression of the desired phenotypic characteristic identified. Two or more generations may be grown to ensure that constitutive expression of the desired phenotypic characteristic is stably maintained and inherited and then seeds harvested to ensure constitutive expression of the desired phenotypic characteristic has been achieved.

The invention in one aspect comprises expression constructs comprising a DNA sequence which encodes upon expression an Rps1-k gene product operably linked to a promoter to direct expression of the protein. These constructs are then introduced into plant cells using standard molecular biology techniques. The invention can be also be used for hybrid plant or seed production, once transgenic inbred parental lines have been established.

In another aspect the invention involves the inhibition of the regulatory gene product in plants through introduction of a construct designed to inhibit the same gene product. The design and introduction of such constructs based upon known DNA sequences is known in the art and includes such technologies as antisense RNA or DNA, co-suppression or any other such mechanism. Several of these mechanisms are described and disclosed in U.S. Pat. No. 5,686,649 to Chua et. al, which is hereby expressly incorporated herein by reference.

The methods of the invention described herein may be applicable to any species of plant.

Production of a genetically modified plant tissue either expressing or inhibiting expression of a structural gene combines the teachings of the present disclosure with a variety of techniques and expedients known in the art. In most instances, alternate expedients exist for each stage of the overall process. The choice of expedients depends on the variables such as the plasmid vector system chosen for the cloning and introduction of the recombinant DNA molecule, the plant species to be modified, the particular structural gene, promoter elements and upstream elements used. Persons skilled in the art are able to select and use appropriate alternatives to achieve functionality. Culture conditions for expressing desired structural genes and cultured cells are known in the art. Also as known in the art, a number of both monocotyledonous and dicotyledonous plant species are transformable and regenerable such that whole plants containing and expressing desired genes under regulatory control of the promoter molecules according to the invention may be obtained. As is known to those of skill in the art, expression in transformed plants may be tissue specific and/or specific to certain developmental stages. Truncated promoter selection and structural gene selection are other parameters which may be optimized to achieve desired plant expression or inhibition as is known to those of skill in the art and taught herein.

The following is a non-limiting general overview of Molecular biology techniques which may be used in performing the methods of the invention.

Promoters

The constructs, promoters or control systems used in the methods of the invention may include a tissue specific promoter, an inducible promoter or a constitutive promoter.

A large number of suitable promoter systems are available. For example one constitutive promoter useful for the invention is the cauliflower mosaic virus (CaMV) 35S. It has been shown to be highly active in many plant organs and during many stages of development when integrated into the genome of transgenic plants and has been shown to confer expression in protoplasts of both dicots and monocots.

Organ-specific promoters are also well known. For example, the E8 promoter is only transcriptionally activated during tomato fruit ripening, and can be used to target gene expression in ripening tomato fruit (Deikman and Fischer, *EMBO J.* (1988) 7:3315; Giovannoni et al., *The Plant Cell* (1989) 1:53). The activity of the E8 promoter is not limited to tomato fruit, but is thought to be compatible with any system wherein ethylene activates biological processes. Similarly the Lipoxegenase ("the LOX gene") is a fruit specific promoter.

Other fruit specific promoters are the 1.45 promoter fragment disclosed in Bird, et al., *Plant Mol. Bio.*, pp 651–663(1988) and the polygalacturonase promoter from tomato disclosed in U.S. Pat. No. 5,413,937 to Bridges et al.

Leaf specific promoters include as the AS-1 promoter disclosed in U.S. Pat. No. 5,256,558 to Coruzzi and the RBCS-3A promoter isolated from pea the RBCS-3A gene disclosed in U.S. Pat. No. 5,023,179 to Lam et al.

And finally root specific promoters include the CamV 35S promoter disclosed in U.S. Pat. No. 391,725 to Coruzzi et al; the RB7 promoter disclosed in U.S. Pat. No. 5,459,252 to Conking et al and the promoter isolated from *Brassica napus* disclosed in U.S. Pat. No. 5,401,836 to Bazczynski et al. which give root specific expression.

Other examples of promoters include maternal tissue promoters such as seed coat, pericarp and ovule. Promoters highly expressed early in endosperm development are most effective in this application. Of particular interest is the promoter from the a subunit of the soybean β-conglycinin gene [Walling et al., *Proc. Natl. Acad. Sci. USA* 83:2123–2127 (1986)] which is expressed early in seed development in the endosperm and the embryo.

Further seed specific promoters include the Napin promoter described in U.S. Pat. No. 5,110,728 to Calgene, which describes and discloses the use of the napin promoter in directing the expression to seed tissue of an acyl carrier protein to enhance seed oil production; the DC3 promoter from carrots which is early to mid embryo specific and is disclosed at *Plant Physiology*, October 1992 100(2) p. 576–581, "Hormonal and Environmental Regulation of the Carrot Lea-class Gene Dc 3, and *Plant Mol. Biol.*, April 1992, 18(6) p. 1049–1063, "Transcriptional Regulation of a Seed Specific Carrot Gene, DC 8": the phaseolin promoter described in U.S. Pat. No. 5,504,200 to Mycogen which discloses the gene sequence and regulatory regions for phaseolin, a protein isolated from *P. vulgaris* which is expressed only while the seed is developing within the pod, and only in tissues involved in seed generation.

Other organ-specific promoters appropriate for a desired target organ can be isolated using known procedures. These control sequences are generally associated with genes uniquely expressed in the desired organ. In a typical higher plant, each organ has thousands of mRNAs that are absent from other organ systems (reviewed in Goldberg, Phil, *Trans. R. Soc. London* (1986) B314–343. mRNAs are first isolated to obtain suitable probes for retrieval of the appropriate genomic sequence which retains the presence of the natively associated control sequences. An example of the use of techniques to obtain the cDNA associated with mRNA specific to avocado fruit is found in Christoffersen et al., *Plant Molecular Biology* (1984) 3:385. Briefly, mRNA was isolated from ripening avocado fruit and used to make a cDNA library. Clones in the library were identified that hybridized with labeled RNA isolated from ripening avocado fruit, but that did not hybridize with labeled RNAs isolated from unripe avocado fruit. Many of these clones represent mRNAs encoded by genes that are transcriptionally activated at the onset of avocado fruit ripening.

Another very important method that can be used to identify cell type specific promoters that allow even to identification of genes expressed in a single cell is enhancer detection (O'Kane, C., and Gehring, W. J. (1987), "Detection in situ of genomic regulatory elements in *Drosophila*", *Proc. Natl. Acad. Sci. USA*, 84, 9123–9127). This method was first developed in *Drosophila* and rapidly adapted to mice and plants (Wilson, C., Pearson, R. K., Bellen, H. J., O'Kane, C. J., Grossniklaus, U., and Gehring, W. J. (1989), "P-element-mediated enhancer detection: an efficient method for isolating and characterizing developmentally regulated genes in *Drosophila*", *Genes & Dev.*, 3, 1301–1313; Skarnes, W. C. (1990), "Entrapment vectors: a new tool for mammalian genetics", *Biotechnology*, 8, 827–831; Topping, J. F., Wei, W., and Lindsey, K. (1991), "Functional tagging of regulatory elements in the plant genome", *Development*, 112, 1009–1019; Sundaresan, V., Springer, P. S., Volpe, T., Haward, S., Jones, J. D. G., Dean, C., Ma, H., and Martienssen, R. A., (1995), "Patterns of gene action in plant development revealed by enhancer trap and gene trap transposable elements", *Genes & Dev.*, 9, 1797–1810).

The promoter used in the method of the invention may be an inducible promoter. An inducible promoter is a promoter that is capable of directly or indirectly activating transcription of a DNA sequence in response to an inducer. In the absence of an inducer, the DNA sequence will not be transcribed. Typically, the protein factor that binds specifically to an inducible promoter to activate transcription is present in an inactive form which is then directly or indirectly converted to the active form by the inducer. The inducer may be a chemical agent such as a protein, metabolite (sugar, alcohol etc.), a growth regulator, herbicide, or a phenolic compound or a physiological stress imposed directly by heat, salt, toxic elements etc. or indirectly through the action of a pathogen or disease agent such as a virus. A plant cell containing an inducible promoter may be exposed to an inducer by externally applying the inducer to the cell such as by spraying, watering, heating, or similar methods. Examples of inducible promoters include the inducible 70 kd heat shock promoter of *D. melanogaster* (Freeling, M., Bennet, D. C., Maize ADN 1, *Ann. Rev. of Genetics*, 19:297–323) and the alcohol dehydrogenase promoter which is induced by ethanol (Nagao, R. T., et al., Miflin, B. J., Ed. Oxford Surveys of Plant Molecular and Cell Biology, Vol. 3, p. 384–438, Oxford University Press, Oxford 1986) or the Lex A promoter which is triggered with chemical treatment and is available through Ligand pharmaceuticals. The inducible promoter may be in an induced state throughout seed formation or at least for a period which corresponds to the transcription of the DNA sequence of the recombinant DNA molecule(s).

Another example of an inducible promoter is the chemically inducible gene promoter sequence isolated from a 27 kd subunit of the maize glutathione-S-transferase (GST II) gene. Two of the inducers for this promoter are N,N-diallyl-2,2-dichloroacetamide (common name: dichloramid) or benzyl-=2-chloro-4-(trifluoromethyl)-5-thiazolecarboxylate (common name: flurazole). In addition, a number of other potential inducers may be used with this promoter as described in published PCT Application No. PCT/GB90/00110 by ICI.

Another example of an inducible promoter is the light inducible chlorophyll a/b binding protein (CAB) promoter, also described in published PCT Application No. PCT/GB90/00110 by ICI.

Inducible promoters have also been described in published Application No. EP89/103888.7 by Ciba-Geigy. In this application, a number of inducible promoters are identified, including the PR protein genes, especially the tobacco PR protein genes, such as PR-1a, PR-1b, PR-1c, PR-1, PR-A, PR-S, the cucumber chitinase gene, and the acidic and basic tobacco beta-1,3-glucanase genes. There are numerous potential inducers for these promoters, as described in Application No. EP89/103888.7.

The preferred promoters may be used in conjunction with naturally occurring flanking coding or transcribed sequences of the feronia regulatory genes or with any other coding or transcribed sequence that is critical to pollin tube formation and/or fertilization.

It may also be desirable to include some intron sequences in the promoter constructs since the inclusion of intron sequences in the coding region may result in enhanced expression and specificity. Thus, it may be advantageous to join the DNA sequences to be expressed to a promoter sequence that contains the first intron and exon sequences of a polypeptide which is unique to cells/tissues of a plant critical to female gametophyte development and/or function.

Additionally, regions of one promoter may be joined to regions from a different promoter in order to obtain the desired promoter activity resulting in a chimeric promoter. Synthetic promoters which regulate gene expression may also be used.

The expression system may be further optimized by employing supplemental elements such as transcription terminators and/or enhancer elements.

Other Regulatory Elements

In addition to a promoter sequence, an expression cassette or construct should also contain a transcription termination region downstream of the structural gene to provide for efficient termination. The termination region or polyadenylation signal may be obtained from the same gene as the promoter sequence or may be obtained from different genes. Polyadenylation sequences include, but are not limited to the Agrobacterium octopine synthase signal (Gielen et al., EMBO J. (1984) 3:835–846) or the nopaline synthase signal (Depicker et al., Mol. and Appl. Genet. (1982) 1:561–573).

Marker Genes

Recombinant DNA molecules containing any of the DNA sequences and promoters described herein may additionally contain selection marker genes which encode a selection gene product which confer on a plant cell resistance to a chemical agent or physiological stress, or confers a distinguishable phenotypic characteristic to the cells such that plant cells transformed with the recombinant DNA molecule may be easily selected using a selective agent. One such selection marker gene is neomycin phosphotransferase (NPT II) which confers resistance to kanamycin and the antibiotic G-418. Cells transformed with this selection marker gene may be selected for by assaying for the presence in vitro of phosphorylation of kanamycin using techniques described in the literature or by testing for the presence of the mRNA coding for the NPT II gene by Northern blot analysis in RNA from the tissue of the transformed plant. Polymerase chain reactions are also used to identify the presence of a transgene or expression using reverse transcriptase PCR amplification to monitor expression and PCR on genomic DNA. Other commonly used selection markers include the ampicillin resistance gene, the tetracycline resistance and the hygromycin resistance gene. Transformed plant cells thus selected can be induced to differentiate into plant structures which will eventually yield whole plants. It is to be understood that a selection marker gene may also be native to a plant.

Transformation

Numerous methods for plant transformation have been developed, including biological and physical, plant transformation protocols. See, for example, Miki et al., "Procedures for Introducing Foreign DNA into Plants" in Methods in Plant Molecular Biology and Biotechnology, Glick, B. R. and Thompson, J. E. Eds. (CRC Press, Inc., Boca Raton, 1993) pages 67–88. In addition, expression vectors and in vitro culture methods for plant cell or tissue transformation and regeneration of plants are available. See, for example, Gruber et al., "Vectors for Plant Transformation" in Methods in Plant Molecular Biology and Biotechnology, Glick, B. R. and Thompson, J. E. Eds. (CRC Press, Inc., Boca Raton, 1993) pages 89–119.

A. Agrobacterium-Mediated Transformation

One method for introducing an expression vector into plants is based on the natural transformation system of Agrobacterium. See, for example, Horsch et al., Science 227: 1229 (1985). A. tumefaciens and A. rhizogenes are plant pathogenic soil bacteria which genetically transform plant cells. The Ti and Ri plasmids of A. tumefaciens and A. rhizogenes, respectively, carry genes responsible for genetic transformation of the plant. See, for example, Kado, C. I., Crit. Rev. Plant. Sci. 10: 1 (1991). Descriptions of Agrobacterium vector systems and methods for Agrobacterium-mediated gene transfer are provided by Gruber et al., supra, Miki et al., supra, and Moloney et al., Plant Cell Reports 8: 238 (1989). See also, U.S. Pat. No. 5,563,055, (Townsend and Thomas), issued Oct. 8, 1996.

B. Direct Gene Transfer

Several methods of plant transformation, collectively referred to as direct gene transfer, have been developed as an alternative to Agrobacterium-mediated transformation. A generally applicable method of plant transformation is microprojectile-mediated transformation wherein DNA is carried on the surface of microprojectiles measuring 1 to 4 µm. The expression vector is introduced into plant tissues with a biolistic device that accelerates the microprojectiles to speeds of 300 to 600 m/s which is sufficient to penetrate plant cell walls and membranes. Sanford et al., Part. Sci. Technol. 5: 27 (1987), Sanford, J. C., Trends Biotech. 6: 299 (1988), Klein et al., Bio/Technology 6: 559–563 (1988), Sanford, J. C., Physiol Plant 79: 206 (1990), Klein et al., Biotechnology 10: 268 (1992). See also U.S. Pat. No. 5,015,580 (Christou, et al), issued May 14, 1991; U.S. Pat. No. 5,322,783 (Tomes, et al.), issued Jun. 21, 1994.

Another method for physical delivery of DNA to plants is sonication of target cells. Zhang et al., Bio/Technology 9: 996 (1991). Alternatively, liposome or spheroplast fusion have been used to introduce expression vectors into plants. Deshayes et al., EMBO J., 4: 2731 (1985), Christou et al., Proc Natl. Acad. Sci. USA. 84: 3962 (1987). Direct uptake of DNA into protoplasts using CaCl2 precipitation, polyvinyl alcohol or poly-L-ornithine have also been reported. Hain et al., Mol. Gen. Genet. 199: 161 (1985) and Draper et al., Plant Cell Physiol. 23: 451 (1982). Electroporation of protoplasts and whole cells and tissues have also been described. Donn et al., In Abstracts of VIIth International Congress on Plant Cell and Tissue Culture IAPTC, A2–38, p 53 (1990); D'Halluin et al., Plant Cell 4: 1495–1505 (1992) and Spencer et al., Plant Mol. Biol. 24: 51–61 (1994).

Following transformation of soybean target tissues, expression of the above-described selectable marker genes allows for preferential selection of transformed cells, tissues and/or plants, using regeneration and selection methods now well known in the art.

It is often desirable to have the DNA sequence in homozygous state which may require more than one transformation event to create a parental line, requiring transformation with a first and second recombinant DNA molecule both of which encode the same gene product. It is further contemplated in some of the embodiments of the process of the invention that a plant cell be transformed with a recombinant DNA molecule containing at least two DNA sequences or be transformed with more than one recombinant DNA molecule. The DNA sequences or recombinant DNA molecules in such embodiments may be physically linked, by being in the same vector, or physically separate on different vectors. A cell may be simultaneously transformed with more than one vector provided that each vector has a unique selection marker gene. Alternatively, a cell may be transformed with more than one vector sequentially allowing an intermediate regeneration step after transformation with the first vector. Further, it may be possible to perform a sexual cross between individual plants or plant lines containing different DNA sequences or recombinant DNA molecules preferably the DNA sequences or the recombinant molecules are linked or located on the same chromosome, and then selecting from the progeny of the cross, plants containing both DNA sequences or recombinant DNA molecules.

Expression of recombinant DNA molecules containing the DNA sequences and promoters described herein in transformed plant cells may be monitored using Northern blot techniques and/or Southern blot techniques known to those of skill in the art.

The transformed cells may then be regenerated into a transgenic plant. The regenerated plants are transferred to standard soil conditions and cultivated in a conventional manner.

After the expression or inhibition cassette is stably incorporated into regenerated transgenic plants, it can be transferred to other plants by sexual crossing. Any of a number of standard breeding techniques can be used, depending upon the species to be crossed.

It may be useful to generate a number of individual transformed plants with any recombinant construct in order to recover plants free from any position effects. It may also be preferable to select plants that contain more than one copy of the introduced recombinant DNA molecule such that high levels of expression of the recombinant molecule are obtained.

As indicated above, it may be desirable to produce plant lines which are homozygous for a particular gene. In some species this is accomplished rather easily by the use of anther culture or isolated microspore culture. This is especially true for the oil seed crop *Brassica napus* (Keller and Armstrong, Z. flanzenzucht 80:100–108, 1978). By using these techniques, it is possible to produce a haploid line that carries the inserted gene and then to double the chromosome number either spontaneously or by the use of colchicine. This gives rise to a plant that is homozygous for the inserted gene, which can be easily assayed for if the inserted gene carries with it a suitable selection marker gene for detection of plants carrying that gene. Alternatively, plants may be self-fertilized, leading to the production of a mixture of seed that consists of, in the simplest case, three types, homozygous (25%), heterozygous (50%) and null (25%) for the inserted gene. Although it is relatively easy to score null plants from those that contain the gene, it is possible in practice to score the homozygous from heterozygous plants by southern blot analysis in which careful attention is paid to the loading of exactly equivalent amounts of DNA from the mixed population, and scoring heterozygotes by the intensity of the signal from a probe specific for the inserted gene. It is advisable to verify the results of the southern blot analysis by allowing each independent transformant to self-fertilize, since additional evidence for homozygosity can be obtained by the simple fact that if the plant was homozygous for the inserted gene, all of the subsequent plants from the selfed seed will contain the gene, while if the plant was heterozygous for the gene, the generation grown from the selfed seed will contain null plants. Therefore, with simple selfing one can easily select homozygous plant lines that can also be confirmed by southern blot analysis.

Creation of homozygous parental lines makes possible the production of hybrid plants and seeds which will contain a modified protein component. Transgenic homozygous parental lines are maintained with each parent containing either the first or second recombinant DNA sequence operably linked to a promoter. Also incorporated in this scheme are the advantages of growing a hybrid crop, including the combining of more valuable traits and hybrid vigor.

The nucleotide constructs of the invention also encompass nucleotide constructs that may be employed in methods for altering or mutating a genomic nucleotide sequence in an organism, including, but not limited to, chimeric vectors, chimeric mutational vectors, chimeric repair vectors, mixed-duplex oligonucleotides, self-complementary chimeric oligonucleotides, and recombinogenic oligonucleobases. Such nucleotide constructs and methods of use, such as, for example, chimeraplasty, are known in the art. Chimeraplasty involves the use of such nucleotide constructs to introduce site-specific changes into the sequence of genomic DNA within an organism. See, U.S. Pat. Nos. 5,565,350; 5,731,181; 5,756,325; 5,760,012; 5,795,972; and 5,871,984; all of which are herein incorporated by reference. See also, WO 98/49350, WO 99/07865, WO 99/25821, and Beetham et al. (1999) *Proc. Natl. Acad. Sci. USA* 96:8774–8778; herein incorporated by reference.

All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims. Thus, many modifications and other embodiments of the invention will come to mind to one skilled in the art to which this invention pertains having the benefit of the teachings presented in the foregoing descriptions and the associated drawings. Therefore, it is to be understood that the invention is not to be limited to the specific embodiments disclosed and that modifications and other embodiments are intended to be included within the scope of the appended claims.

The following examples are offered by way of illustration and not by way of limitation.

DETAILED DESCRIPTION OF THE PREFERRED EMBODIMENT

Example 1

Materials and Methods

Growing of soybean and *Phytophthora sojae*: inoculation and disease scoring: Soybean seedlings were grown under light conditions for two weeks (Bhattacharyya and Ward, 1986). *P. sojae* race 1 was grown in the dark at 22° C. and zoospores were obtained from 6-day-old cultures (Ward et al., 1979). Segregating materials from the cross between the pair of near-isogenic lines (NILs) 'Elgin' and 'Elgin 87' were tested for their responses to *P. sojae* race 1 by inoculating detached leaves with zoospores suspensions (Bhattacharyya and Ward, 1986). Unifoliate leaves of two-week-old $F_2$ seedlings were detached and placed in Petri plates carrying Whatman filter papers moistened in 10 ml water.

Petioles of leaves were kept under a film of water and leaf blades were inoculated with drops of 10 µl zoospores suspensions carrying about 1000 zoospores. The infected leaves were scored for disease development 3 and 5 day following inoculation. Susceptible responses are characterized by rapidly spreading light-brown lesions. Resistant symptoms are normally dark brown necrotic lesions about the size of inoculum droplets. Occasionally a little spread was seen during the first three days, but the spreading lesions were dark brown.

Analysis of Segregants and Identification of Recombinants:

Five molecular markers BAC(1+2), CG1, TC1, Tgmr and TC1-F were used in isolating and characterizing recombinants. Four of these markers were described earlier (Kasuga et al., 1997). BAC120(1+2) is a cleaved amplified polymorphic marker (CAP; (Konieczny and Ausubel, 1993). It was developed by BclI digestion of PCR products representing a two kb single copy sequence, identified from BAC120. Tgmr is a dominant marker, and was developed by using primers specific to the sequences of the Tgmr target site and Tgmr.

To identify a recombinant carrying a chromosomal breakpoint in TC1-CG1 interval 979 $F_2$ plants developed from the cross between the pair of NILs Elgin and Elgin 87 were screened for disease phenotypes, and 240 susceptible plants were considered for further investigation. Approximately equal amounts of leaf samples were mixed from three susceptible plants to obtain 80 pools from 240 plants. Twelve micrograms DNA from each pool were digested with BglII and Southern blot analyses were carried out for CG1 and TC1. A single recombinant 910 (R910) was identified from this screen. To confirm the homozygosity of R910 Southern analysis was carried out using both BAC120 (1+2) and TC1-F probes. Homozygous R910 is susceptible to P. sojae race 1 and carries both Elgin- and Elgin 87-specific TC1 alleles. Therefore, in R910 a breakpoint is located in between TC1 allelomorphs of rps1-k and Rps1-k haplotypes. The TC1-F marker was revealed by the TaqI digested genomic DNA hybridized to the TC1 probe, while BAC120 (1+2) was by BclI digested DNA hybridized to the BAC120 (1+2) probe. None of the susceptible plants showed any recombination between Rps1-k and BAC120(1+2).

A recombinant between Rps1-k and BAC120(1+2) was identified as follows. Eight hundred and sixty two $F_2$ plants were evaluated for disease phenotypes and markers BAC120 (1+2) and Tgmr. Candidate recombinants were transferred to the greenhouse for generating $F_3$ seeds. Progeny testing of the candidate recombinants for disease phenotypes and RFLP patterns of BAC120(1+2), CG1, TC1 and TC1-F resulted in the identification of the recombinant 213 (R213), which is recessive homozygous for BAC120(1+2), but heterozygous for CG1, Rps1-k, TC1 and TC1F. Therefore, a recombination breakpoint is located between BAC120(1+2) and CG1 in R213.

DNA preparation, PCR and Southern analyses: Soybean genomic DNA was prepared from leaves of selected individual plants or pools of three plants according to White and Kaper (White and Kaper, 1989). A touchdown PCR program with initial denaturing temperature of 94° C. for 2 minutes, and then denaturing temperature of 94° C. for 30 sec at the beginning of each cycle, annealing temperature dropping from 60° C. to 55° C. @–1° C./cycle, and extension temperature of 72° C. for 1 min/cycle was used. A total of 35 cycles were carried out with the final annealing temperature 55° C. Southern analysis was carried out according to the protocol described earlier (Kasuga et al., 1997).

Linkage analysis: In the isolation of R910 a total of 480 chromatids were evaluated, whereas for R213 1724 chromatids were analyzed. Genetic distances between Rps1-k and TC1, and Rps1-k and BAC120(1+2), were calculated by using the Map Manager program (Manly and Cudmore, 1995).

Preparation of high molecular weight (HMW) DNA and construction of a BAC library: Williams 82 plants were grown in growth chambers under standard growing conditions (Bhattacharyya and Ward, 1986; Kasuga et al., 1997). HMW DNA from young unifoliate leaves of Williams 82 was prepared following the protocols described earlier (Salimath and Bhattacharyya, 1999). Agarose plugs carrying approximately 8–10 µg of HMW DNA were prepared (76 µl volume). About 150 plugs were prepared in a single batch and tested for quality by digesting the DNA with HindIII in the presence or absence of magnesium chloride. The plugs were sent to GenomicSystems, Inc. (St. Louis) for construction of a BAC library in the pBeloBAC11 vector (Kim et al., 1996). A copy of the library and sets of DNA filters carrying DNA samples from individual BAC clones were obtained from GenomicSystems, Inc. and used in the present investigation. Analyses of BAC clones were carried out according to Salimath and Bhattacharyya (1999).

Subcloning and sequencing of BAC clones: Three overlapping BAC clones, BAC18, BAC43 and BAC99 carrying the Rps1-k locus were sequenced using a shot-gun approach. To minimize E. coli DNA contamination, DNA of the three BAC clones was prepared with Qiagen Large Construct Kit (Qiagen, Valencia, Calif.). Two shotgun libraries for each BAC clone were constructed. One library was made using Topo shotgun subcloning kit (Invitrogen, Carlsbad, Calif.). Briefly, individual BAC DNA was nebulized under 5 psi for 10 seconds. Fragments of 5 to 10 kb were blunt-ended, dephosphorylated and ligated to vector pCR4BluntTOPO. For the other library, DNA of each BAC was partially digested with Sau3AI, DNA fragments around 20 kb were purified and then ligated into the dephosphorylated BamHI restriction site of the binary vector pTF101.1 and pTF101.1 clones were obtained. Colonies were picked randomly and stored in 96-well microtiter plates. Plasmid DNA was prepared applying Montage plasmid Miniprep Kit (Millipore, Bedford, Mass.). DNA sequencing was run on ABI PRISM 3700 Analyzer by the DNA sequencing facility at Iowa State University. The sequence data were assembled using Phred/Phrap software on a Linux computer. The resulted contigs of each BAC were ordered into scaffold manually using the read pairs. Primer walking was applied to fill in the remaining gaps. The assembled sequences were searched against GenBank using the BlastX algorithm (www.ncbi.nlm.gov). Four NBS-LRR-type genes were identified. A series of primers for both strands were designed in every 200–300 bp from the consensus sequence of the four NBS-LRR sequences.

Sequencing and sequence Analysis of NBS-LRR clones: The pTF101.1 clones used for sequencing were hybridized to NBS or/and LRR probes. The positive clones were then classified into seven putative groups by DNA finger-printing. At least one clone from each group and a total of 13 clones were sequenced using primers designed based on the consensus NBS-LRR sequence. Each nucleotide was sequenced at least three times. The sequence reads of each clone were assembled using Vector NTI (Suite 6) program. The gene structure was predicted with Genscan (www.genes.mit.edu/GENSCAN.html).

cDNA cloning: Upper $1/3^{rd}$ portion of the etiolated hypocotyls of 7-day old dark grown seedlings expressing Rps genes was used to generate a cDNA library in the Uni-ZAP XR lambda vector (Stratagene, Inc., CA) (Ward et al., 1981; Bhattacharyya, 2001). About 4.6×10$^6$ plaque forming units (pfus) from this unamplified library were screened using LRR domain of the Rps1-k-1 (the LRR-Rps1-k-1 probe) gene family. Positive clones were purified and excised for sequencing.

Phosphorimage analysis and copy number estimation: To determine the copy number of LRR160-like sequences, Southern blot analysis was carried out for variable amounts of soybean genomic DNA and the pG02 plasmid containing Rps1-k-1. The size of the insert DNA is 8.7 kb and the total size of pG02 is 17.8 kb. Salmon sperm DNA was digested with BamHI and mixed with HindIII digested soybean genomic DNA or pG02 DNA to adjust the amounts of all samples to 5 μg in order to avoid any variation in blotting that may otherwise arise due to differences in the amount of DNA quantities. The DNA samples were run on a 0.8% agarose gel at 20 volts for 24 h. The gel was blotted and hybridized to the ($^{32}$p)-labeled LRR-Rps1-k-1 probe and the blot was exposed to storage phosphor screen for 48 hr. The extent of hybridization of the probe to the 2.3 kb HindIII fragment was determined using a PhosphorImager (Molecular dynamics Variable mode imager-Typhoon 8600). Analysis of the phosphorimages was carried out using ImageQuant software (Tutorial version 5.0) and the volume of the each hybridizing signal was determined. Two linear graphs, one for pG02 and the other for soybean DNA, were developed using the Microsoft Excel program. Based on the linear relationships between amounts of DNA and density-volume estimation in the phosphorimager, the amounts of pG02 and soybean DNA required for 500,000 units band intensity was 702 pg and 3.12 μg, respectively. If the soybean genome (1150 Mb; Arumuganathan and Earle, 1991) carries a single copy of this LRR sequence, then the amount of soybean DNA necessary for 500,000 units band intensity is 92.84 μg $\{(1150,000\times702)/(8.7\times1000,000)\}$. Therefore, the copy number of LRR sequences to produce the 2.3 kb HindIII fragment is 30 (92.84/3.12). There are 8 additional HindIII fragments that hybridize to the LRR probe in addition to the 2.3 kb fragment. Therefore, the total copy number of LRR sequence is estimated to be at least 38.

Results

Isolation of recombinants for the Rps1 region: In mapping the Rps1 region, earlier we studied segregating populations derived from three independent crosses between pairs of NILs (Kasuga et al., 1997). We observed that genotypes carrying all the recombination breakpoints mapped between Tgmr and TC1 were identified from the F$_3$ families of the cross between Williams (rps1-k) and Williams 82 (Rps1-k), whereas breakpoints of two recombinants mapped in the TC1-CG1 interval were isolated from the F$_2$s of crosses between Elgin 300 (rps1-k) and OX717 (Rps1-k), and Elgin (rps1-k) and E420 (Rps1-k) (T. Kasuga and M. K. Bhattacharyya, unpublished results). These two pairs of NILs are derivatives of the NILs Elgin and Elgin 87 (Kasuga et al., 1997). These results indicated that recombination events in the Rps1-k region are influenced by genotypes of the parents.

FIG. 1. A BAC contig at the Rps1-k region. Several BAC libraries carrying 24 genome equivalents were screened for AFLP markers TC1 and CG1. BAC33, BAC120 and BAC160 were obtained from a BAC library carrying five genome equivalent clones of average size ~50 kb (S. S. Salimath and M. K. Bhattacharyya, unpublished results). BAC11 and BAC23 were isolated from a separate BAC library that carries five genome equivalent clones of average size ~150 kb (Marek and Shoemaker, 1997). BAC18, 43 and 99 were isolated from a BAC library carrying 10 genome equivalent DNA clones of average size 125 kb (C. Baublite and M. K. Bhattacharyya, unpublished).

To identify more recombinants for the genomic regions flanking Rps1-k, we developed a population of over 2000 F$_2$ plants from the cross between Elgin and Elgin 87. A cleaved amplified polymorphic marker 120(1+2) was developed from a single copy sequence of BAC120. Tgmr and 120(1+2) were used to screen the F$_2$ population and, as expected, two recombinants were identified for the TC1-120(1+2) interval. Recombinant 213 (R213) carries a recombination breakpoint between CG1 and 120(1+2). Recombinant 910 (R910) carries both resistant- and susceptible-specific TC1 alleles. All F$_3$ progenies of R910 (rps1-k) were susceptible to Phytophthora sojae race 1 and carried both TC1-specific alleles. Presumably an unequal crossing-over event between TC1 allelomorphs-specific to the Elgin (rps1-k) and Elgin 87 (Rps1-k) haplotypes resulted in the rearrangement observed in R910. R213 was obtained from screening 1724 chromatids, whereas R910 was identified from screening 480 chromatids. Therefore, according to this study, the genetic distances between Rps1-k and 120(1+2), and TC1 and Rps1-k, are 0.06 and 0.21 cM, respectively. R910 and R213 were used in this investigation.

FIG. 2. LRR-160 is highly polymorphic between two near-isogenic lines (NIL) that differ for Rps1-k alleles. DNA samples from NILs Elgin (rps1-k) and Elgin 87 (Rps1-k) were digested with 10 restriction enzymes. S, Elgin; R, Elgin 87.

Construction of a BAC contig for the Rps1-k region: Rps1-k was mapped between TC1 and CG1 markers (Kasuga et al., 1997). To develop a contig in the Rps1-k region, a cosmid library carrying eight genome equivalents of DNA and several BAC libraries carrying 24 genome equivalents of DNA were screened and results are summarized in FIG. 1 (Bhattacharyya et al., 1997; Marek and Shoemaker, 1997; Salimath and Bhattacharyya, 1999; S. S. Salimath and M. K. Bhattacharyya, unpublished results; C. Baublite and M. K. Bhattacharyya, unpublished). These libraries were constructed using high molecular weight DNA prepared from the cultivar Williams 82. No cosmid clones containing either TC1 or CG1 were obtained. BAC33, BAC120 and BAC160 were obtained from a BAC library carrying five genome equivalents of DNA with an average insert size ~50 kb (S. S. Salimath and M. K. Bhattacharyya, unpublished results). BAC160 and BAC33 carry TC1 and CG1, respectively. BAC11 containing TC1 and BAC23 carrying one end of BAC33 were isolated from a separate BAC library that carries five genome equivalents of DNA (Marek and Shoemaker, 1997). The average insert size of this library is ~150 kb; but BAC11 and BAC23 carry only about 40-kb-long inserts. BAC120 was obtained from screening of a BAC library for a BAC33 end-specific probe (S. S. Salimath and M. K. Bhattacharyya, unpublished). None of these BACs contains CG1. Chromosomal walks from either BAC160 or BAC23 toward Rps1-k was not successful because of the high repetitiveness of the BAC160 and BAC23 ends that are close to the locus.

All disease resistance genes except Pto and Rpg1 carry leucine rich repeat sequences and most LRR-type disease resistance genes occur in clusters, and usually only one type of LRR gene is predominant in a given genomic region. Therefore, we hypothesized that: (i) Rps1-k is an LRR-type resistance gene, and (ii) paralogous Rps1-k sequences would be present in any of the BACs that were adjacent to Rps1-k.

Identification of such sequences would then allow us to identify the BACs that carry Rps1-k. We sequenced random fragments from both BAC160 and BAC23 and identified a 2.3 kb HindIII fragment that carries an LRR sequence from BAC160. This sequence, LRR160, showed highest identity (35%) to the tomato disease resistance gene I2C-1 (Ori et al., 1997). This fragment was used to screen two libraries, one of which was constructed in collaboration with GenomeSystems, Inc. (St. Louis) (C. Baublite and M. K. Bhattacharyya, unpublished). The library comprised of 92,160 BAC clones representing 10 soybean haploid genomes. The average insert size of BAC clones of this library is about 125 kb. The other library was constructed in Shoemaker Laboratory (Marek and Shoemaker, 1997). BAC18, 43 and 99 were isolated from the new library by using the LRR160 probe. Recombinants R910 and R213 were applied to confirm the map position of these three BACs. A 1.6 kb EcoRI fragment identified from BAC43 and BAC99 was mapped to the TC1-CG1 interval. The end of BAC99, distal from BAC43 carries a retroelement sequence that is highly repeated in the soybean genome. Therefore, a chromosomal walk from BAC99 was not possible. A long-range PCR using BAC99- and BAC23-specific primers applied to amplify the DNA fragment from the gap region was also unsuccessful. We have determined the size of BAC18, 23 and 33 by separating NotI-digested BAC DNA in a CHEF gel, and DNA finger printing. BAC18, 43 and 99 were sequenced and sizes of these clones were determined from their sequences. Based on the data from these experiments the physical distance between TC1 and CG1 was determined to be about 320 kb.

LRR160-like sequences are highly repetitive and polymorphic: Southern blot analysis of near-isogenic lines Elgin and Elgin 87 using ten different restriction endonucleases indicated that the LRR160 sequence is highly repetitive and polymorphic between the two lines for all ten enzymes studied (FIG. 2). Similar results were obtained from the analysis of Williams and Williams 82. The polymorphic nature of this repeat element between pairs of near-isogenic lines differing Rps1-k indicates that most copies, if not all, must be located somewhere in the introgressed DNA fragment containing Rps1-k.

Unequal crossing over in the Rps1-k region: In order to define the Rps1-k locus the breakpoint in R910 was investigated by using the BAC18-end (18R) that overlaps with BAC160. BclI-digested F$_3$s of R910 and F$_2$s of R213 revealed that 18R hybridized to three DNA fragments of Elgin, whereas four fragments of Elgin 87 (FIG. 3). Homozygous progenies of R910 showed a novel rearrangement for these sequences (FIG. 3a); two Elgin-specific fragments were observed along with all four Elgin 87-specific fragments among the unusual segregants. TC1 alleles from both rps1-k and Rps1-k haplotypes were also fixed among homozygous progenies of R910 (data not shown). Both TC1 and 18R sequences segregate normally among progenies of the heterozygous R213 (FIG. 3b). Multi-copy TC1 and 18R are physically linked and novel rearrangements for these two markers among progenies of R910 were resulted in presumably from of unequal crossing-over event. The mapping of 18R confirmed that BAC43, 18 and 99 but not 160 are from the genomic region that carries Rps1-k. We conclude that the Rps1-k locus spans between 18R and CG1.

FIG. 3. Illegitimate recombination in the Rps1-k region. The BAC18 end (18R) that overlaps with BAC 160 was mapped using ten F$_3$ progenies (a, lane 1–10) and ten F$_2$s (b, lane 1–10) of R910 and R213, respectively. The DNA samples were digested with BclI for this RFLP mapping experiment. R, resistant parent Elgin 87-specific genotype; S, susceptible parent Elgin-specific genotype; H, heterozygotes; N, novel genotype that carries all R-specific and two S-specific (shown by arrows) fragments. R910 contains a breakpoint in between allelomorphs of 18R and TC1.

Identification of a cluster of 160LRR-like sequences in the Rps1-k region: In order to study (i) if the candidate LRR sequence is also present in BAC23 and 33 and (ii) the organization of the sequence around the Rps1 region Southern blot analysis was carried using the contiguous BAC clones of the Rps1-k region shown in FIG. 4A. BAC92 and BAC95 were reported earlier (Salimath and Bhattacharyya, 1999). BAC70 was identified from a library constructed in Bhattacharyya Lab by using a BAC92-end-specific probe (Salimath and Bhattacharyya, 1999). BAC212 was identified from a library constructed in Shoemaker Lab (Marek and Shoemaker, 1997). The other BACs are presented in FIG. 1. The LRR160-like sequences are absent in BAC23, 33 and 120 (FIG. 4B). Several copies were however identified on the other side of the Rps1-k locus.

FIG. 4. Identification of a cluster of LRR160-like sequences from the Rps1-k region. A, BAC clones that cover the region spanning from TC1-F to 120(1+2). B, BAC clones shown in A were digested with EcoRI and hybridized to LRR160. LRR160-like sequences were observed from the Rps1-k region to the TC1-F marker. No sequences from BAC23, 33 and 120 hybridized to the probe. The 1.6 kb EcoRI fragment showed by an arrow co-segregates with the Rps1-k locus.

FIG. 5. Comparison of cDNA sequences with members of the candidate Rps1-k gene family. A, Structure of a LRR sequence identified from the Rps1-k locus is shown. C-C, coiled coild domain; NBS, nucleotide binding site domain; LRR, leucing rich repeat region. Two white rectangles just after TAG are introns. The black bar indicates the region used to compare sequences of two classes of genes from the Rps1-k locus with that of cDNAs isolated in this investigation. B, Comparison of candidate Rps1-k gene sequences cCDNA_9-50, cDNA_10-1-3; cDNA_44 as set forth in SEQ ID NOS: 155–158 respectively with cDNA sequences. Rps1-k-2 (SEQ ID NO: 153) and Rps1-k-3 (SEQ ID NO: 154) represent two classes of identical genes isolated from the Rps1-k locus.

DNA samples of BAC18, 43 and 99 were partially digested with Sau3A and about 15–20 kb fragments were cloned into the binary vector pTF101.1 (Frame et al., 2002) and 768 clones (referred to pTF101.1 clone) were picked and both ends of inserts were sequenced. Shot gun sequencing of BAC18, 43 and 99 were also carried out to identify all possible LRR160-like sequences from the Rps1-k locus. Based on (i) random sequencing of BAC18, 43 and 99, and (ii) complete sequencing ORFs of 13 pTF101.1 clones representing seven classes of LRR160-like sequences revealed that there are at least five distinct LRR-containing genes in a cluster around BAC43. No second type of LRR sequences or any other potential open reading frames for Rps1-k was detected from sequences of BAC18, 43 and 99. These five genes Rps1-k-1, -2, -3, -4 and -5, the candidate Rps1-k gene family, form two classes. Between members of the two classes 93% and 89% identity were observed at the nucleic acid and amino acid levels, respectively. Members from each class showed 100% identity at both nucleic acid and amino acid levels.

Expression of the gene family in tissues expressing Rps1-k-specific resistance: A cDNA cloning approach was applied to investigate the transcripts of the candidate Rps1-k gene family. The Rps gene-specific resistance is expressed in upper $\frac{1}{3}^{rd}$ portion of etiolated soybean hypocotyls (Ward et al., 1981). A total of $4.6 \times 10^6$ plaque forming units (pfus) from an unamplified cDNA library constructed from the 1/3rd portion of etiolated soybean hypocotyls were screened using the LRR domain of a candidate Rps1-k-1 gene (pG02). Seven cDNAs, representing four classes of genes, with high identity to the candidate Rps1-k gene family were isolated from the cDNA screening experiments. Comparison of nucleotide sequences of one member from each class of cDNAs with that of one member from each class of the candidate Rps1-k gene family showed that none of the cDNAs showed 100% identity with any member of the candidate Rps1-k gene family (FIG. 5). Two introns were identified at the 3'-untranslated region of the candidate Rps1-k gene family. These results indicate that (i) four members of the LRR-gene family discovered in this investigation transcribed to a detectable level (transcript level ~$4.7 \times 10^{-7}$), and (ii) transcripts of the candidate Rps1-k gene family is not detectible by the cDNA cloning strategy.

FIG. 6. Copy number of the LRR sequences. (A) Phosphoimage of a Southern blot carrying HindIII digested plasmid pGO2 DNA (a, 5,700 pg; b, 3,800 pg; c, 3,325 pg; d, 2,850 pg; e, 2,375 pg; f, 1,990 pg; g, 1,710 pg; h, 1,520 pg; I, 1,330 pg; j, 1,140 pg; k, 950 pg; l, 760 pg; m, 570 pg; n, 380 pg; o, 190 pg) and soybean genomic DNA (1, 1 µg; 2, 2 µg; 3, 3 µg; 4, 4 µg; and 5, 5 µg) samples hybridized to pGO2-specific LRR sequence. (B) Linear relationship between intensity of hybridization signals (volume) and adjusted concentration of pGO2 DNA content. Values shown in A are adjusted by subtracting the DNA contents for the 9.1 kb pTF101.1 vector. For example, adjusted values for a, b and o are 2770, 1847 and 92 pg, respectively. (C) Linear relationship between intensity of hybridization signals (volume) and concentrations of soybean genomic DNA in picograms.

FIG. 7. Mapping of the LRR sequences using near-isogenic lines. (A) Genotype of NILs used in mapping LRR160 are shown against a genetic map of the Rps1-k region. Dark lines represent DNA from the introgressed region carrying Rps1-k. Faint lines represent the DNA from susceptible lines. (B) Southern blot of TaqI digested genomic DNA was hybridized to the pGO2-specific LRR probe and arrows are used to show the LRR sequences mapped to different loci shown in FIG. 7D. Arrows show the Williams 82-specific fragments that disappeared in the recombinant lines due to exchange of DNA strands between parents. For example, the LRR-a fragment is missing from all recombinant lines except R910 or R213 (data not presented). Therefore, this locus was mapped in between recombination break points of R910 and R1-02. In the first panel a heterozygote R1-02 recombinant genotype (R1-02{Hetero}) is included to show that this recombinant received the Williams-specific fragment LRR-b not the LRR-a, which is slightly smaller than LRR-b. LRR-c is missing in all recombinants except in R1-02 (FIG. 7B-a), R910 and R213. Therefore, the LRR-c locus mapped in between the breakpoints of R-02 and R4-55. LRR-d and -e are missing in R4-62, and instead, two Williams-specific fragments LRR-e and -f were observed in this recombinant. Therefore, these fragments were mapped in between breakpoints of R2-15 and R4-62. LRR1, -2, and -3 are mnomorphic and could not be mapped. DraI-digested DNA revealed that the Williams 82-specific pA280 allele (shown by arrow in FIG. 7C-a) is missing in Flyer, therefore, this line carries a breakpoint between Tgmr and pA280. Flyer carries all the LRR sequences observed in Resnik and a fragment-specific to A3127 (shown by arrows in FIGS. 7C-b). TaqI-digested DNA (FIGS. 7C-c) supported the results observed for DraI digested DNA that was probed with the LRR probe (FIGS. 7C-b). Flyer carries two A3127 (recurrent parent)-specific TaqI fragments LRR-i and -k in addition to all LRR sequences from the donor parent Williams 82 (FIGS. 7C-c). LRR sequences specific to A3127 observed in Flyer but not in Resnik were mapped to the pA280 locus tentatively. These sequences can, however, be mapped to a locus (loci), south of pA280. Polymorphic fragments LRR-h and -j-specific to Williams 82 were found in Flyer and also in R213 that does not carry any Williams 82 specific DNA beyond CG1 {breakpoint between CG1 and 120(1+2)}. These sequences were also found in other recombinants. Therefore, these were mapped between breakpoints of Flyer and R4-62.

Candidate Rps1-k genes are members of a large family of resistance gene-like sequences: Plant disease resistance genes commonly occur in clusters. For example the Dm3 gene cluster carries 24 copies in the lettuce genome (Meyers et al., 1998; Chin et al., 2001). Southern analysis of LRR160 revealed that the sequence is highly repetitive. EcoRI and TaqI digestions released many polymorphic DNA fragments between the two lines. To the contrary, the HindIII digestion produced one intensely hybridizing and eight additional DNA bands. The 2.3 kb intense band represents a group of HindIII fragments that are conserved among most copies of the repeat element (FIG. 2). We carried out a Southern blot experiment in order to estimate the copy number of the repeat sequences in the intensely hybridizing HindIII fragment. Soybean genomic DNA along with plasmid pG02 DNA carrying a member of the candidate Rps1-k gene family were digested completely with HindIII and separated in an agarose gel. Blot of these DNA samples was hybridized to the pGO2-specific LRR probe and analyzed using a phosphoimager (FIG. 6). The copy number for LRR-like sequences in the soybean genome was calculated by comparing the band intensity of the 2.3 kb HindIII genomic fragment with that of the 2.3 kb HindIII plasmid pGO2-specific fragment. This comparative analysis indicated that the intensely hybridizing 2.3 kb HindIII fragment could represent about 30 copies. Therefore, the total members of this class of LRR-type sequences in the soybean genome could be about 38.

Organization of the related members of the candidate Rps1-k gene family: The organization of members of the LRR sequences discovered in this investigation was studied by high resolution mapping of the sequence with the aid of near-isogenic lines that contain recombination breakpoints in the Rps1-k region. Homozygous recombinants R1.02, R2.15, R4.55, and R4.62 carrying recombination breakpoints between Rps1-k and TC1-F, were identified in our previous study (Kasuga et al., 1997). These lines were selfed to obtain homozygous lines with breakpoints in the TC1-F and Rps1-k interval (Kasuga et al., 1997). Sister lines Flyer and Resnik were developed by introgressing Rps1-k from Williams 82 into the cv. A3127. Earlier we detected a recombination breakpoint between the marker pA280 and Rps1-k in Flyer but not in Resnik (Bhattacharyya et al., 1997). Therefore, Flyer does not carry the Williams 82-specific allele of pA280. Hence, these three lines were also included in this study. The chromosomal breakpoints in these near-isogenic lines are shown in FIG. 7A. The genetic distance between Rps1-k and pA280 is about 3 cM (Bhattacharyya et al., 1997; Kasuga et al., 1997). Southern blot analysis of these lines revealed that most members of the LRR sequences of the Rps1-k haplotype are distributed over a small genomic region encompassing Rps1-k and pA280. In this interval all Williams 82-specific LRR-like sequences except three monomorphic TaqI fragments were mapped to six distinct loci including Rps1-k and LRR160 (FIG. 7D). Some rps1-k haplotype-specific TaqI fragments such as LRR-i and k were putatively mapped to the pA280 locus (FIG. 7D).

Discussion

As a first step toward understanding the molecular basis of the soybean-*Phytophthora sojae* interaction, we applied a map-based cloning approach to isolate the most stable and widely used *Phytophthora* resistance gene Rps1-k. In the Rps1 locus five functional genes; Rps1-a, -b, -c, -d and -k were genetically mapped. In this article we describe the positional cloning, expression and organization of a family of highly repetitive coiled-coil NBS-LRR-type disease resistance sequence, at least five members of which are the only R-gene-like sequences present in the Rps1 locus.

The Rps1-k locus mapped to a recombination-suppressed region: The high resolution map published earlier showed that the genetic distance between TC1-F and CG1 is 0.7 cM (Kasuga et al., 1997). Based on the contig presented in FIG. 4 the physical distance between TC1-F and CG1 is about 670 kb and contains a gap. Therefore, average physical distance/cM in the TC1-F and CG1 interval is about 1 Mb/cM. We observed a variation in the recombination rates in this region. Between TC1-F and TC1 markers, the physical and genetic distances are ~350 kb and 0.57 cM, respectively, and therefore, a relationship of ~615 kb/cM is observed. The genetic and physical distances between TC1 and CG1 are 0.13 cM and ~320 kb, respectively, and therefore, a relationship of about 2.5 Mb/cM was calculated for the TC1-CG1 interval carrying the Rps1-k gene. In soybean the total genetic map distance is 3000 cM, genome size is about 1150 megabases and the average physical distance/cM for the whole genome is about 383 kb/cM (Arumuganathan and Earle, 1991; Cregan et al., 1999). Considering these estimates, over six-fold reduction in the recombination rate for the Rps1-k region as compared to that in the whole genome was observed.

A suppression of recombination frequency in the Rps1-k region as compared to that in the rest of the genome could be due to divergence of this region between the Rps1-k and rps1-k haplotypes. Alternatively the region could be located near a heterochromatic area. Recombination frequencies in genomic regions carrying disease resistance genes are suppressed in many crop species (van Daelen et al., 1993; Ganal and Tanksley, 1996; Wei et al., 1999; Chin et al., 2001). On the contrary, enhanced recombination rates have been also reported for regions carrying other resistance genes (Collins et al., 1999; Graham et al., 2000; Deslandes et al., 2002). Recombination rates tend to vary several folds throughout the genome with higher rates of recombination in the euchromatic regions and much lower rates in the heterochromatic regions including centromeres (Tanksley et al., 1992; Sandhu and Gill, 2002). Tomato resistance gene Mi was introgressed from *Lycopersicon peruvianum*, and suppression of recombination in the Mi region is considered to be the result of alien origin of the introgressed fragment and also proximity of the gene to the cetromere (Kaloshian et al., 1998). The barley Mla6 allele of the Mla cluster was introgressed from a wild relative and suppression of recombination is considered to be due to the high rate of polymorphisms at the Mla cluster (Wei et al., 1999). On the contrary, Rps1-k was introgressed from the cultivar Kingwa (*G. max*). Previously we reported polymorphisms for 10% of the DNA fragments from cvs. Williams and Kingwa as opposed to only 2% of the DNA fragments from Williams and Elgin. The amount of polymorphisms between Kingwa and Williams is again about three-fold higher at the Rps1-k region than that in the rest of the genome (Kasuga et al., 1997). Thus, we observed a very high level of polymorphisms at the Rps1 region. High rate of recombination in the maize Rp1 locus is considered to result in rapid evolution of new specificities. The implication of reduced recombination rates in disease resistance loci is not yet understood. Higher levels of polymorphisms at the loci like Mla or Rps1 could only result in unequal crossing over and duplication of resistance genes. Poor recombination frequencies in those loci presumably establish the identity of duplicated genes that undergo point mutation and diversified selection for the generation of new race specificities.

Related members of the candidate Rps1-k gene family are organized as clustered loci: We have sequenced BAC clones of the Rps1-k region and observed that LRR sequences discovered in this investigation are the only class of sequences that have similarities to disease resistance genes (Ori et al., 1997). Based on sequencing of 13 individual LRR copies from BAC18, 43 and 99 five distinct members of the LRR gene family were identified from the Rps1-k region. Candidate LRR sequences representing Rps1-k have several related members in the soybean genome. Transcripts of four members were identified from cDNA cloning experiments. Candidate Rps1-k genes are transcribed at a level undetectable by the conventional cDNA cloning approach. Endonucleases BclI, BglII and HindIII resulted in one or two intensely hybridizing bands (FIG. 2). This indicates that most copies were originated from a common ancestor through duplication. For example, at least 30 copies of the LRR-like sequences carry a unique 2.3 kb HindIII fragment (FIGS. 2 and 6). Five copies isolated from the Rps1-k region share very high identity, and in fact they form two classes of identical genes. These results indicate that an active gene duplication mechanism is operative in the Rps1-k region.

We have mapped most of these LRR sequences to six distinct loci in a 3 cM region carrying Rps1-k at one end (FIG. 7D). Occurrence of clusters of paralogous disease resistance gene sequences has appeared to be the rule rather than the exception. Twenty-four paralogous downy mildew resistance gene sequences were identified from about 3.5 megabases of sequences in lettuce (Meyers et al., 1998; Chin et al., 2001). Likewise, in tomato duplication before organization of homologues of Cf-9 into two distinct loci has been suggested (Parniske and Jones, 1999). Multiple paralogous sequences are also clustered in single loci of the same or different chromosomes (Song et al., 1995; Dixon et al., 1996; Anderson et al., 1997). Simple organization of resistance genes is almost an exception (Grant et al., 1995). On the contrary, although it is rare, three distinct NBS-LRR resistance gene homologue families were discovered in the Mla locus (Wei et al., 1999). We used TaqI-digested DNA of recombinants in mapping four additional loci carrying LRR sequences related to candidate Rps1-k genes. It is worth noting that in the Rps1-k region, local duplication is not restricted to these LRR sequences. Earlier we have reported local duplication of molecular markers in the 3 cM region that carries Rps1-k (Kasuga et al., 1997). Here we have shown the duplication of two physically associated molecular markers among progenies of the recombinant R910 (FIG. 3-*a*). It appears that local duplication is a general characteristic of the Rps1-k region.

Unequal crossing over for tandem duplication and creation of new race-specificities: These highly related LRR sequences were perhaps evolved through a regional duplication phenomenon. A possible role of transposable element in resistance gene multiplication has been discussed (Parniske and Jones, 1999). To date, no active transposable element has been identified in soybean. Furthermore, polymorphic sequences were mapped to a small genomic region. This favors a local duplication mechanism rather than transposition events for their multiplication. Tandem paralogous sequences can be originated through unequal crossing over. Unequal recombination could be either inter- or intra-genic. Intra-genic recombination has been shown to create new race-specificity in flax (Luck et al., 2000). A similar mechanism may be responsible for the creation of new race-specificities in the Rp1 locus of maize (Hulbert et al., 2001). Frequent unequal crossing over tends to homogenize duplicated sequences that have undergone mutation and diversification. This slows down the process of evolution of new race specificities among duplicated genes (Hulbert et al., 2001). Paralogous Dm3 and Pto loci sequences are more diverse than orthologous sequences of two lines or species indicating rareness of unequal crossing over in these two loci (Michelmore and Meyers, 1998). Rps1-k and rps1-k haplotypes are highly diverse, and therefore, any crossing over in this region will most likely be an unequal one. Of the two recombinants studied, R910 carries rps1-k- and Rps1-k-specific alleles for both 18R and TC1 loci that are physically linked (FIG. 3 and data not shown). Allelomorphs of these two loci from both haplotypes recombined in R910 presumably through an unequal crossing over. Most likely the very same mechanism leads to tandem duplication of LRR sequences in the Rps1-k region. Duplicated functional resistance genes, resulted in from such an event, then undergo diversifying selection for the evolution of new race-specificity. In this process the frequency of mutants showing new race-specificities will be much fewer than the number of loss of function mutants. Availability of many duplicated copies ensures redundancy of functions, and provides a means for generating new variation without compromising necessary resistance specificities against the prevalent pathogenic races. Thus, tandem duplication through unequal crossing over between highly diverse haplotypes results in a unique opportunity for the evolution new race-specificities. Reduced recombination rates in the Rps1-k region keep the novel genotypes, generated through unequal crossing over, free from any further rearrangements and, thereby, preserve their identities. We propose that unequal crossing over resulted in tandem duplication of disease resistance gene sequences within the Rps1 region leading to evolution of new *Phytophthora*-resistance specificities.

REFERENCES

Anderson, P. A., Lawrence, G. J., Morrish, B. C., Ayliffe, M. A., Finnegan, E. J., and Ellis, J. G. (1997). Inactivation of the flax rust resistance gene M associated with loss of a repeated unit within the leucine-rich repeat coding region. Plant Cell 9, 641–651.

Arumuganathan, K., and Earle, E. D. (1991). Nuclear DNA content of some important plant species. Plant Mol. Biol. Rep. 9, 208–218.

Bhattacharyya, M. K. (2001). Construction of cDNA libraries. In Essential Molecular Biology: A Practical Approach, T. A. Brown, ed (Oxford University Press), pp. 42–62.

Bhattacharyya, M. K., and Ward, E. W. B. (1986). Expression of gene-specific and age-related resistance and the accumulation of glyceollin in soybean leaves infected with *Phytophthora megasperma* f.sp. *glycinea*. Physiol. Mol. Plant. Pathol. 29, 105–113.

Bhattacharyya, M. K., Gonzales, R. A., Kraft, M., and Buzzell, R. I. (1997). A copia-like retrotransposon Tgmr closely linked to the Rps1-k allele that confers race-specific resistance of soybean to *Phytophthora sojae*. Plant Mol Biol 34, 255–264.

Chin, D. B., Arroyo-Garcia, R., Ochoa, O. E., Kesseli, R. V., Lavelle, D. O., and Michelmore, R. W. (2001). Recombination and spontaneous mutation at the major cluster of resistance genes in lettuce (*Lactuca sativa*). Genetics 157, 831–849.

Collins, N., Drake, J., Ayliffe, M., Sun, Q., Ellis, J., Hulbert, S., and Pryor, T. (1999). Molecular characterization of the maize Rp1-D rust resistance haplotype and its mutant. Plant Cell 11, 1365–1376.

Cregan, P. B., Jarvik, T., Bush, A. L., Shoemaker, R. C., Lark, K. G., Kahler, A. L., Kaya, N., VanToai, T. T., Lohnes, D. G., Chung, J., and Specht, J. E. (1999). An integrated genetic linkage map of the soybean genome. Crop Sci. 39, 1464–1490.

Deslandes, L., Olivier, J., Theulieres, F., Hirsch, J., Feng, D. X., Bittner-Eddy, P., Beynon, J., and Marco, Y. (2002). Resistance to *Ralstonia solanacearum* in *Arabidopsis thaliana* is conferred by the recessive RRS1-R gene, a member of a novel family of resistance genes. Proc Natl Acad Sci USA 99, 2404–2409.

Dixon, M. S., Jones, D. A., Keddie, J. S., Thomas, C. M., Harrison, K., and Jones, J. D. (1996). The tomato Cf-2 disease resistance locus comprises two functional genes encoding leucine-rich repeat proteins. Cell 84, 451–459.

Frame, B. R., Shou, H., Chikwamba, R. K., Zhang, Z., Xiang, C., Fonger, T. M., Pegg, S. E., Li, B., Nettleton, D. S., Pei, D., and Wang, K. (2002). *Agrobacterium tumefaciens*-Mediated Transformation of Maize Embryos Using a Standard Binary Vector System. Plant Physiol 129, 13–22.

Ganal, M. W., and Tanksley, S. D. (1996). Recombination around the Tm2a and Mi resistance genes in different crosses of *Lycopersicon peruvianum*. Theor. Appl. Genet. 92, 101–108.

Graham, M. A., Marek, L. F., Lohnes, D., Cregan, P., and Shoemaker, R. C. (2000). Expression and genome organization of resistance gene analogs in soybean. Genome 43, 86–93.

Grant, M. R., Godiard, L., Straube, E., Ashfield, T., Lewald, J., Sattler, A., Innes, R. W., and Dangl, J. L. (1995). Structure of the *Arabidopsis* RPM1 gene enabling dual specificity disease resistance. Science 269, 843–846.

Hulbert, S. H., Webb, C. A., Smith, S. M., and Sun, Q. (2001). Resistance gene complexes: evolution and utilization. Annu. Rev. Phytopathol. 39, 285–312.

Kaloshian, I., Yaghoobi, J., Liharska, T., Hontelez, J., Hanson, D., Hogan, P., Jesse, T., Wijbrandi, J., Simons, G., Vos, P., Zabel, P., and Williamson, V. M. (1998). Genetic and physical localization of the root-knot nematode resistance locus mi in tomato. Mol. Gen. Genet. 257, 376–385.

Kasuga, T., Salimath, S. S., Shi, J., Gijzen, M., Buzzell, R. I., and Bhattacharyya, M. K. (1997). High resolution genetic and physical mapping of molecular markers linked to the *Phytophthora* resistance gene Rps1-k in soybean. Mol. Plant-Microbe Interact. 10, 1035–1044.

Kim, U. J., Birren, B. W., Slepak, T., Mancino, V., Boysen, C., Kang, H. L., Simon, M. I., and Shizuya, H. (1996). Construction and characterization of human bacterial artificial chromosome library. Genomics 34, 213–218.

Konieczny, A., and Ausubel, F. M. (1993). A procedure for mapping *Arabidopsis* mutations using co-dominant ecotype-specific PCR-based markers. Plant J. 4, 403–410.

Luck, J. E., Lawrence, G. J., Dodds, P. N., Shepherd, K. W., and Ellis, J. G. (2000). Regions outside of the leucine-rich repeats of flax rust resistance proteins play a role in specificity determination. Plant Cell 12, 1367–1377.

Manly, K., and Cudmore, R. (1995). Map Manager Version 2.6.5. Web site: mcbio.med.buffalo.edu/mapmgr.html.

Marek, L. F., and Shoemaker, R. C. (1997). BAC contig development by fingerprint analysis in soybean. Genome 40, 420–427.

Meyers, B. C., Chin, D. B., Shen, K. A., Sivaramakrishnan, S., Lavelle, D. O., Zhang, Z., and Michelmore, R. W. (1998). The major resistance gene cluster in lettuce is highly duplicated and spans several megabases. Plant Cell 10, 1817–1832.

Michelmore, R. W., and Meyers, B. C. (1998). Clusters of resistance genes in plants evolve by divergent selection and a birth-and-death process. Genome Res. 8, 1113–1130.

Ori, N., Eshed, Y., Paran, I., Presting, G., Aviv, D., Tanksley, S., Zamir, D., and Fluhr, R. (1997). The I2Cfamily from the wilt disease resistance locus I2 belongs to the nucleotide binding, leucine-rich repeat superfamily of plant resistance genes. Plant Cell 9, 521–532.

Pamiske, M., and Jones, J. D. (1999). Recombination between diverged clusters of the tomato Cf-9 plant disease resistance gene family. Proc. Natl. Acad. Sci. USA 96, 5850–5855.

Salimath, S. S., and Bhattacharyya, M. K. (1999). Generation of a soybean BAC library, and identification of DNA sequences tightly linked to the Rps1-k disease resistance gene. Theor. Appl. Genet. 98, 712–720.

Sandhu, D., and Gill, K. S. (2002). Gene-containing regions of wheat and the other grass genomes. Plant Physiol 128, 803–811.

Song, W.-Y., Wang, G.-L., Kim, H.-S., Pi, L.-Y., Holsten, T., Gardner, J., Wang, B., Zhai, W.-X., Zhu, L.-H., Fauquet, C., and Ronald, P. (1995). A receptor kinase-like protein encoded by the rice disease resistance gene, Xa21. Science 270, 1804–1806.

Tanksley, S. D., Ganal, M. W., Prince, J. P., de Vicente, M. C., Bonierbale, M. W., Broun, P., Fulton, T. M., Giovannoni, J. J., Grandillo, S., Martin, G. B., and et al. (1992). High density molecular linkage maps of the tomato and potato genomes. Genetics 132, 1141–1160.

van Daelen, R. A. J. J., Gerbens, F., Ruissen, F.v., Aarts, J., Hontelez, J., and Zabel, P. (1993). Long-range physical maps of two loci (Aps-1 and GP79) flanking the root-knot nematode resistance gene (Mi) near the centromere of tomato chromosome 6. Plant mol biol 23, 185–192.

Ward, E. W. B., Stössel, P., and Lazarovits, G. (1981). Similarities between age-related and race-specific resistance of soybean hypocotyls to *Phytophthora megasperma* var. *sojae*. Phytopathology 71, 504–508.

Ward, E. W. B., Lazarovits, G., Unwin, C. H., and Buzzell, R. I. (1979). Hypocotyl reactions and glyceollin in soybeans inoculated with zoospores of *Phytophthora megasperma* var. *sojae*. Phytopathology 69, 951–955.

Wei, F., Gobelman-Werner, K., Morroll, S. M., Kurth, J., Mao, L., Wing, R., Leister, D., Schulze-Lefert, P., and Wise, R. P. (1999). The Mla (powdery mildew) resistance cluster is associated with three NBS-LRR gene families and suppressed recombination within a 240-kb DNA interval on chromosome 5S (1HS) of barley. Genetics 153, 1929–1948.

White, J. L., and Kaper, J. M. (1989). A simple method for detection of viral satellite RNAs in small plant tissue samples. J. Virol. Methods 23, 83–94.

Example 2

Materials and Methods

Subcloning and sequencing of BAC clones: Three overlapping BAC clones, BAC18, BAC43 and BAC99 carrying the Rps1-k locus were sequenced using a shot-gun approach. To minimize *E. coli* DNA contamination, DNA of the three BAC clones was prepared with Qiagen Large Construct Kit (Qiagen, Valencia, Calif.). Two shotgun libraries for each BAC clones were constructed. One library was made using Topo shotgun subcloning kit (Invitrogen, Carlsbad, Calif.). Briefly, individual BAC DNA was nebulized under 5 psi for 10 seconds. Fragments of 5 to 10 kb were blunt-ended, dephosphorylated and ligated to vector pCR4BluntTOPO. For the other library, DNA of each BAC was partially digested with Sau3AI, DNA fragments around 20 kb were purified and then ligated into the dephosphorylated BamHI restriction site of the binary vector pTF101.1 (refer these clones to pTF101.1 clones). Colonies were picked randomly and stored in 96-well microtiter plates. Plasmid DNA was prepared applying Montage plasmid Miniprep Kit (Millipore, Bedford, Mass.). DNA sequencing was run on ABI PRISM 3700 Analyzer by the DNA sequencing facility at Iowa State University.

The sequence data were assembled using Phred/Phrap software on a PC using Linux operating system. The resulted contigs of each BAC were ordered into scaffold manually using the read pairs. Primer walking was applied to fill the remaining gaps. The assembled sequences were searched against GenBank using BlastX algorithm (http://). Four NBS-LRR-type genes were identified. A series of primers for both strands were designed in every 200–300 bp from the consensus sequence of the four NBS-LRR sequences.

Sequencing and sequence Analysis of NBS-LRR clones: The pTF101.1 clones used for sequencing were hybridized to NBS or/and LRR probes. The positive clones were then classified into seven putative groups by DNA finger-printing. At least one clone from each group and a total of 13 clones were sequenced using primers designed based on the consensus NBS-LRR sequence. Each nucleotide was sequenced at least three times. The sequence reads of each clone were assembled using Vector NTI Suite 6 (v.6 for PC, InforMax Inc.) program. The gene structure was predicted with Genscan (www.genes.mit.edu/GENSCAN.html).

Complementation analyses: Genomic clones 99-6A (Rps1-k-2), 43-10 (Rps1-k-3) and 43-JP1 (Rps1-k-5) carrying DNA fragments from BAC99 and BAC43 in pTF111.1 vector, were electroporated into the *Agrobacterium tumefaciens* strain EHA101 (Zhang et al., 1999). The *Agrobacterium*-mediated transformation of cotyledonary explants of the cultivar Williams 79 (Rps1-c) for these plasmids was performed by Plant Transformation Facility at Iowa State University. $R_1$ progenies of independent transformants derived from 99-6A, 43-10 and 43-JP1 were tested for Rps1-k-specific resistance. Detached soybean leaves from two-week-old soybean plants or etiolated hypocotyls of seven-day old seedlings were inoculated with zoospore suspensions of the *P. sojae* race 4 (Bhattacharyya and Ward, 1986). In leaves symptoms were evaluated 48 and 72 hours following inoculation. The average spread of lesions per day was then determined. Inoculated hypocotyls were evaluated 24 h following inoculation for resistant (hypersensitive cell death) and susceptible (lack of hypersensitive cell death) responses.

Results

Identification and characterization of five highly identical candidate genes from the Rps1-k region: Rps1-k has been mapped to a region that is physically spanned by three overlapping soybean bacterial artificial chromosomes (BACs) clones: BAC18, BAC43, and BAC99 isolated from a library prepared from the cultivar Williams 82 (Rps1-k) (Bhattacharyya, unpublished data). Five highly identical C-C NBS-LRR-type genes were identified through sequencing of these three BACs and subsequent sequencing of the NBS-LRR clones in the binary vector pTF101.1. Except for a truncated serinine/threonine kinase sequence, no other disease resistance gene homologs were revealed from sequence analysis of the three BACs. Therefore, we designated the five C-NBS-LRR-type genes as Rps1-k-1 to Rps1-k-5. Open reading frames (ORFs) of members of this Rps1-k gene family share 93% to 100% nucleotide and 89.9% to 100% amino acid sequence identity (Table 1); and all the ORFs carry no introns. One hundred and five variable positions, aside from three deletions of one, two, and 21 amino acids, were identified in these ORFs. Thirty-four variable positions were found at the N-terminus of the protein, which has a C-C motif and a NBS domain, and 71 at the C-terminus of the protein that carries a LRR domain. There are only two alternative residues in all mutations; these are called informative polymorphic sites (IPSs) because they occur in more than one gene (FIG. 8). These two residues in each position distinguish the two classes of genes. There are three deletions in the 5'-end region, and 6 and 84 IPSs at the 5'- and 3'-end regions, respectively (FIG. 8). Nucleotide sequences of members of the Rps1-k gene family are depicted in the FIG. 9. Three genes, Rps1-k-1, -3, and -5, have identical ORFs and represent one class, whereas identical genes Rps1-k-2 and Rps1-k-4 represent the other. Identical sequences among genes isolated from an approximately 280 kb contiguous DNA fragment of the Rps1-k region made it difficult to identify all members of the gene family. We conclude that there are at least five genes at the Rps1-k locus.

Figure 8:
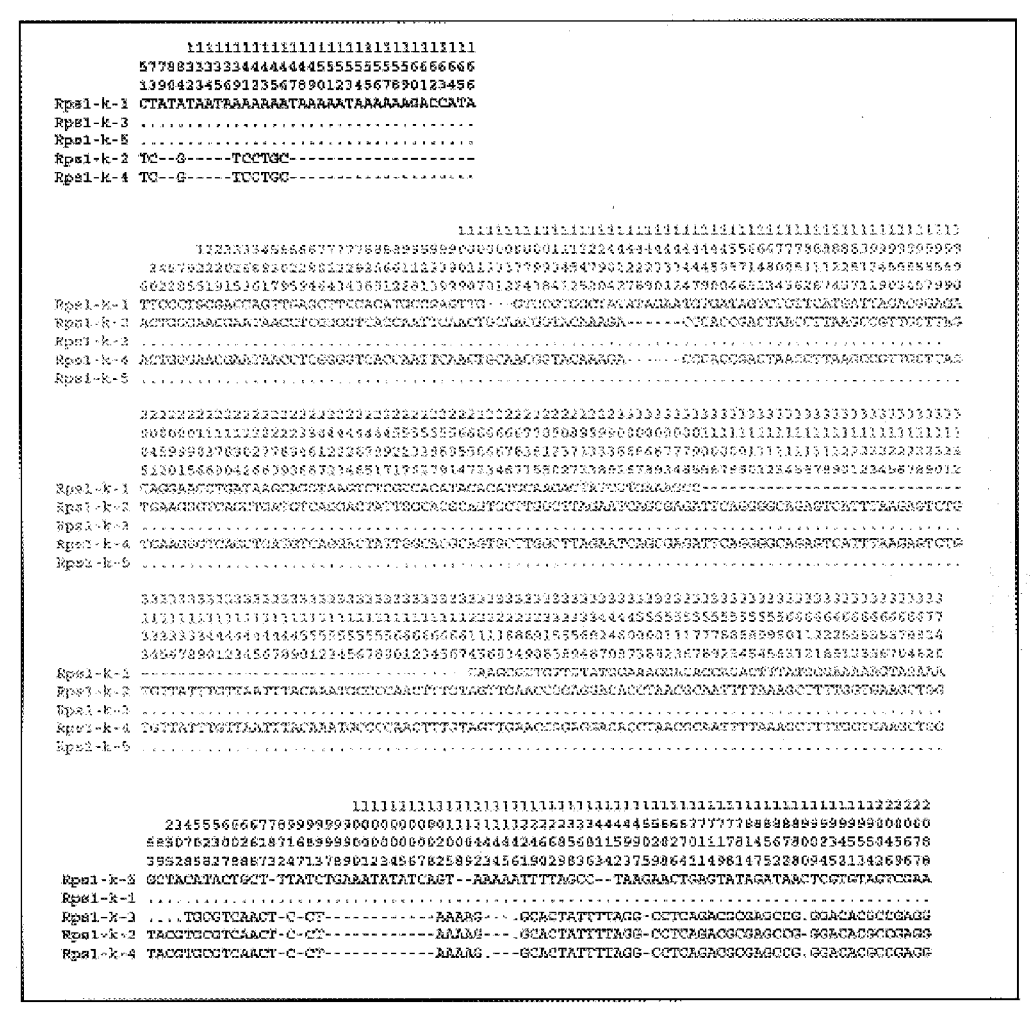

FIG. 8. Alignment of informative polymorphic sites among members of the Rps1-k gene family. (A) IPSs and deletions of 5'-end regions. (B) IPS and deletions among ORFs. (C) IPSs and deletions of 3'-end regions. The Sequence Output for DOS, Version 2.0, was used for this analysis (B. G. Spratt, University of Sussex, Brighton, UK).

TABLE 1

Comparison of open reading frame sequences among members of the Rps1-k gene family

|           | Rps1-k-1 | Rps1-k-2 | Rps1-k-3 | Rps1-k-4 | Rps1-k-5 |
|-----------|----------|----------|----------|----------|----------|
| Rps1-k-1  |          | [1]93.0  | 100.0    | 93.0     | 100.0    |
| Rps1-k-2  | [2]89.9  |          | 93.0     | 100.0    | 93.0     |
| Rps1-k-3  | 100.0    | 89.9     |          | 93.0     | 100.0    |
| Rps1-k-4  | 89.9     | 100.0    | 89.9     |          | 93.0     |
| Rps1-k-5  | 100.0    | 89.9     | 100.0    | 89.9     |          |

[1]Upper diagonal (blue): nucleotide sequence comparison.
[2]Lower diagonal (red): amino acid sequence comparison.

FIG. 9. The Rps1-k gene family comprising two classes of identical genes. In developing this figure, informative polymorphic sites (IPSs) were used to trace the lineages of individual genes. Red and black colors show the lineages of members of the gene family. Rps1-k-1 and -5 are identical genes that were cloned from nonoverlapping BAC18 and BAC99. Rps1-k-3 is distinguished from Rps1-k-1 and -5 by a recombination breakpoint between nts 302 and 478 from the stop codon. Rps1-k-2 and -4 are identical except for a single nt deletion at position 1900 from the stop codon. ■, the conserved nucleotide binding site; *, deletion of an nt; deletion of 63 nts; □, two introns of 142 and 152 nts, respectively.

Six structural domains were identified from the predicted proteins (FIG. 10). A myristylation site can be found in domain A. The coiled-coil motif is located in domain B. The putative NBS domain consisting of the P loop as well as kinase-2 and kinase-3a motifs is present in domain C (Traut, 1994). In this region, all 11 Pan-defined motifs for CC-NBS-LRR R proteins were observed (Pan et al., 2000). Between domain C and E is a short region designated as domain D. Domain E consists of 27 imperfect LRRs, one of which was deleted from Rps1-k-1, -3, and -5 (FIGS. 8 and 9). The deduced amino acid sequences of Rps 1-k family show the highest identity to I2C-2.

FIG. 10. Amino acid sequence comparison between Rps1-k-2 and Rps1-k-3. The predicted amino acid sequence of Rps1-k-2 is shown under domains A to F, indicating differences between the two protein sequences. The myristylation site in domain A is underlined. The coiled-coil domain is in domain B. The prediction was performed by COILS (Lupas, 1997). The conserved P loop as well as kinase-2 and kinase-3a sequences in NBS are underlined. The LRR alignment is shown in domain E. The consensus sequence in LRRs is indicated by xxLxLxx in the line above the alignment of LRRs (L can be replaced by V, F or M). The leucine-zipper-like motif is shown in bold. Domain F is the C-terminus. The red-highlighted residues are the sites that vary between Rps1-k-2 and Rps1-k-3. One LRR repeat of 21 amino acids was deleted from Rps1-k-3 and is shown by green color in Rps1-k-2.

Diversifying selection and frequency of mutation in Rps1-k genes: Solvent-exposed residues within the consensus sequence xxLxLxx of LRRs are highly divergent (Jones and Whittingham, 1996) (FIG. 10). To determine the selection pressure exerted on the Rps1-k gene family, ratios of synonymous (Ks) and nonsynonymous (Ka) substitution were calculated for different regions of the two classes (Table 2). The highest Ka/Ks ratio observed was for the xxLxLxx sequence of the LRRs indicating the pressure of diversifying selection on the predicted solvent-exposed residues necessary for the creation of new race specificities (Pamiske et al., 1997; Meyers et al., 1998). Comparisons of frequencies of mutation in C-C, NBS, and LRR domains with those in 5'- and 3'-end regions revealed that mutation frequencies were almost the same, about 0.02 per site among all regions except the LRR domains, where a tenfold higher frequency of nonsynonymous substitution mutation was observed between members of two Rps1-k gene classes (Table 3). This indicates that LRR domains are prone to the spontaneous mutation required for generating new race-specific resistance.

Complementation analysis: To establish the functional identity of members of the Rps1-k gene family, three genomic clones 99-6A (Rps1-k-2), 43-10 (Rps1-k-3) and 43-JP1 (Rps1-k-5) were introduced into the soybean cv. Williams 79 (Rps1-c) through the *Agrobacterium*-mediated transformation procedures (Zhang et al., 1999). Independent $R_0$s as well as $R_1$ and $R_2$ progeny populations confirmed that all three genes encode Rps1-k-specific resistance in soybean leaves ($R_1$) and etiolated hypocotyls ($R_2$) against *P. sojae* race 4 (FIG. 11 and Table 4). $R_1$ progenies of all three independent transformants carrying Rps1-k-3 and one transformant carrying Rps1-k-2 or Rps1-k-5 showed a segregating 3:1 ratio of resistance to susceptibility. Segregation of resistance and susceptibility was observed among $R_2$ progenies.

TABLE 2

Rates of non-synonymous (Ka) and synonymous (Ks)[1] substitutions in the evolution of the Rps1-k gene family

| Region/Domain | Ka/Ks |
|---|---|
| ORF | 0.625 |
| Coiled-coil domain | 0.29 |
| NBS domain | 0.33 |
| XxLxLxx[2] | 2.33 |
| C-terminus (LRR-xxLxLxx) | 1 |

[1]The ratio of non-synonymous (Ka) and synonymous (Ks) substitution in variable sites was calculated by comparing the ORF sequences of Rps1-k-2 and Rps1-k-3. The SNA program (Synonymous/Non-synonymous Analysis Program: (www.hiv-web.lanl.gov/content/hiv-db/SNAP/WEB-SNAP/SNAP.html) was used in calculating the substitution values.
[2]Conserved hydrophobic sites (L, V, F, and M) were omitted from the calculation of the Ka/Ks ratio in the xxLxLxx region.

TABLE 3

A tenfold increase in nonsynonymous mutation frequency among LRRs

| | | ORF | | | | | | |
|---|---|---|---|---|---|---|---|---|
| | | C-C | | NBS | | LRR (only repeats) | | |
| Region Mutation | 5'-end | Synonymous | Nonsynonymous | Synonymous | Nonsynonymous | Synonymous | Nonsynonymous | 3'-end |
| Subtitutions | 6 | 6 | 7 | 18 | 23 | 6 | 54 | 60 |
| Total Length | 298 | | 336 | | 1056 | | 300[1] | 2095 |
| Mutation Frequency | 0.02 | 0.017 | 0.021 | 0.017 | 0.022 | 0.02 | 0.18 | 0.028 |

TABLE 4

Segregation of transgenes among $R_1$ progeny populations

| $R_1$ | R[1] | S | $X^2_{(3:1)}$ | P ($X^2_{(3:1)}$) |
|---|---|---|---|---|
| [2]T-Rps1-k-2-1 | 11 | 6 | 0.961 | 0.327 |
| T-Rps1-k-2-2 | 2 | 16 | 39.185 | <0.0001 |
| T-Rps1-k-2-3 | 2 | 15 | 36.255 | <0.0001 |
| T-Rps1-k-2-4 | 0 | 16 | 48.000 | <0.0001 |
| T-Rps1-k-2-5 | 5 | 10 | 13.899 | 0.0002 |
| [2]T-Rps1-k-3-1 | 13 | 5 | 0.074 | 0.785 |
| [2]T-Rps1-k-3-2 | 11 | 7 | 1.852 | 0.174 |
| [2]T-Rps1-k-3-3 | 13 | 5 | 0.074 | 0.785 |
| [2]T-Rps1-k-5-1 | 10 | 2 | 0.444 | 0.505 |

[1]R, resistant phenotype; S, susceptible phenotype.
[2]Showed a 3:1::R:S segregation ratio.

Co-segregation of a transgene copy with the expression of *Phytophthora* resistance: Transgenic plants showed to carry multiple T-DNA inserts. We investigated if the complemented resistance phenotype is encoded by a transgene. Progenies from individual R1 plants carrying the transgene Rps1-k-2 were investigated for expression of *P. sojae* race 4-specific resistance and segregation of transgene copies. The results of an experiment are presented in FIG. 12. The expression of *Phytophthora* resistance among the $R_2$ progenies correlated positively with one of the transgene copies. This confirmed that Rps1-k-2 encodes *Phytophthora* resistance. However, we have not been able to find any correlation between the integration of transgenes Rps1-k-3 and Rps1-k-5 with the complemented resistance phenotype.

Soybean genome comprised of about 38 copies of the Rps1-k-like sequences (Bhattacharyya, unpublished). Most likely the transcriptional gene silencing phenomenon may have suppressed the expression of copies of the Rps1-k transgenes in transgenic plants (Vaucheret and Fagard, 2001). We applied an RT-PCR approach to determine the association between observed phenotypes and the transgene expression. Two primers representing sequences that flank these two adjacent introns were applied to carry out the RT-PCR experiment and results are presented in the FIG. 12. A clear-cut association between the complemented resistant phenotype and amplification of a cDNA fragment from the Rps1-k-5 transgene was observed among progenies of the T-Rps1-k-5-1 (Table 4).

FIG. 11. The complementation analysis of three genes isolated from the Rps1-k locus. (A) A transgenic $R_0$ leaf shows hypersensitive cell death and typical resistance response. (B) Symptom development among $R_1$ progeny populations. Lesion size was recorded two and three days following inoculation and lesion spread was determined in millimeters per day.

FIG. 12. Co-segregation of an Rps1-k-2 transgene copy with the expression of resistance against *P. sojae* race 4. Etiolated hypocotyls of individual $R_2$ plants from independent $R_1$ progenies were inoculated with the zoospore suspensions and infected seedlings were evaluated 24 h following inoculation (Ward et al. 1979). *Phytophthora* resistance was co-segregated with a transgene, which is shown by an arrow.

Discussion

Five Rps1-k genes were identified through map-based cloning. They were grouped into two classes. These genes are transcribed to a level undetectable by conventional cDNA cloning experiments (Bhattacharyya, unpublished). Function of one gene was established by complementation and Southern blot analyses. Sequence analyses indicated they all encode C-C NBS-LRR type resistance genes. Complete sequence identity among individual members of each class indicated that they were evolved through a local gene duplication of two progenitor genes (FIG. 9). At least two rounds of duplication resulted in new members of the Rps-k gene family. A single nucleotide-deletion mutation occurred following duplication; it was detected among 6149 residues of Rps1-k-2 (FIG. 9). Concerted evolution has been shown to have a major role in evolution of tandemly arranged repeat sequence families, such as snRNAs in humans (Liao et al., 1997) and rDNA in yeast (Gangloff et al., 1996). However, it is unlikely that the high identity observed among members of the Rps1-k gene family resulted from this concerted evolution. Homogenization, a requirement for concerted selection, acts against the diversification and generation of novel race-specificities. Parniske et al. (Parniske et al., 1997) proposed that sequence homogenization could be prevented by the suppression of unequal recombination between two polymorphic intergenic sequences. Rps1-k is located in a highly recombination-suppressed region; therefore, homogenization is unlikely the reason for 100% identity among members of individual Rps1-k gene classes (Bhattacharyya unpublished). Gene conversion, a major sequence homogenization mechanism for concerted selection, is not a likely cause for 100% identity between members of individual Rps1-k gene classes either. Gene conversion tracts are mostly limited to ORFs and are relatively small (Hilliker et al., 1994; Semple and Wolfe, 1999; Drouin, 2002).

To date, no two identical R genes have been identified from the same haplotype. In flax, L3 and L10 carry identical ORFs, while L4 differed from these two by a single nucleotide (Ellis et al., 1999). However, L3, L4, and L10 are from three independent haplotypes. Two nearly identical resistance genes were cloned from the tomato Cf-2 locus. These two genes differ by three nucleotide or amino acids (Dixon et al., 1996). Duplicated functional genes in an R gene cluster as in Rps-k provide advantages for generation of new resistance genes. One member of duplicated genes preserves the original race specificity for the existing pathogenic races, while others can advance the evolution for new race specificities.

Two progenitor genes differing at 58 synonymous substitutions in the ORF of 3756 nts and giving rise to two Rps1-k gene classes must have started to diverge about 10 million years ago. The evolution of members of the Rps1-k gene family from these two progenitor genes most likely occurred through unequal crossing over following natural cross-pollination. The alternative and lesser-likely scenario would be the evolution of both progenitor genes from the same haplotype followed by relatively recent evolution of individual members of Rps1-k gene classes through a regional duplication mechanism.

In self-pollinated species lettuce, the loss-of-function mutants are generated at a rate of $6 \times 10^{-4}$ per generation, mostly from large deletions (Chin et al., 2001). In the tomato, however, no spontaneous loss-of-function mutants were identified from selfed-progenies (Parniske et al., 1997). Self-pollinated species are less likely to produce genetic variation through unequal crossing over, which usually occurs between two diverse haplotypes following open pollination in cross-pollinated species. This raises a question about the mechanism(s) of duplication for evolution of new variations in self-pollinated species. Unequal crossing over between two identical Rps1-k haplotypes of a soybean line can occur through the mispairing of repeat sequences. This mechanism allows the duplication of DNA sequences of two identical haplotypes in a self-pollinated plant species leading to the generation of new genetic variations for those traits that require rapid evolution. Identical *Phytophthora* resistance genes at the Rps1-k locus support the existence of such a mechanism in soybean.

REFERENCES

Anderson, T. R., and Buzzell, R. I. (1992). Inheritance and linkage of the Rps 7 gene for resistance to *Phytophthora* rot of soybean. Plant Dis. 76, 958–959.

Bhattacharyya, M. K., and Ward, E. W. B. (1986). Expression of gene-specific and age-related resistance and the accumulation of glyceollin in soybean leaves infected with *Phytophthora megasperma* f.sp. *glycinea*. Physiol. Mol. Plant Pathol. 29, 105–113.

Bhattacharyya, M. K., Narayanan, N. N., Salimath, S. S., Santra, D. K., Ellison, L., Kasuga, T., Liu, Y., Espinosa, B., Marek, L., Shoemaker, R. C., Gijzen, M., Buzzell, R. I. (2003). Positional Cloning of a Highly Repetitive LRR-type Disease Resistance Gene Sequence that Co-Segregates with the *Phytophthora* Resistance Gene Rps1-k in Soybean. Genetics.

Brueggeman, R., Rostoks, N., Kudrna, D., Kilian, A., Han, F., Chen, J., Druka, A., Steffenson, B., and Kleinhofs, A. (2002). The barley stem rust-resistance gene Rpg1 is a novel disease-resistance gene with homology to receptor kinases. Proc Natl Acad Sci USA 99, 9328–9333.

Burnham, K. D., Dorrance, A. E., Francis, D. M., Fioritto, R. J., Martin, S. K. St. (2003). Rps8, A New Locus in Soybean for Resistance to *Phytophthora sojae*. Crop Sci 43, 101–105.

Chin, D. B., Arroyo-Garcia, R., Ochoa, O. E., Kesseli, R. V., Lavelle, D. O., and Michelmore, R. W. (2001). Recombination and spontaneous mutation at the major cluster of resistance genes in lettuce (*Lactuca sativa*). Genetics 157, 831–849.

Deslandes L, Olivier J, Theulieres F, Hirsch J, Feng D X, Bittner-Eddy P, Beynon J, Marco Y. (2002). Resistance to Ralstonia solanacearum in *Arabidopsis thaliana* is conferred by the recessive RRS1-R gene, a member of a novel family of resistance genes. Proc Natl Acad Sci USA 99, 2404–2409

Dixon, M. S., Jones, D. A., Keddie, J. S., Thomas, C. M., Harrison, K., and Jones, J. D. (1996). The tomato Cf-2 disease resistance locus comprises two functional genes encoding leucine-rich repeat proteins. Cell 84, 451–459.

Drouin, G. (2002). Characterization of the gene conversions between the multigene family members of the yeast genome. J Mol Evol 55, 14–23.

Ellis, J. G., Lawrence, G. J., Luck, J. E., and Dodds, P. N. (1999). Identification of regions in alleles of the flax rust resistance gene L that determine differences in gene-for-gene specificity. Plant Cell 11, 495–506.

Frame, B. R., Shou, H., Chikwamba, R. K., Zhang, Z., Xiang, C., Fonger, T. M., Pegg, S. E., Li, B., Nettleton, D. S., Pei, D., and Wang, K. (2002). *Agrobacterium tumefaciens*-Mediated Transformation of Maize Embryos Using a Standard Binary Vector System. Plant Physiol 129, 13–22.

Gangloff, S., Zou, H., and Rothstein, R. (1996). Gene conversion plays the major role in controlling the stability of large tandem repeats in yeast. Embo J 15, 1715–1725.

Hammond-Kosack, K. E., Jones, J. D. G. (1997). Plant disease resistance genes. Annu. Rev. Plant Physiol. Plant Mol. Biol. 48, 575–607.

Hilliker, A. J., Harauz, G., Reaume, A. G., Gray, M., Clark, S. H., and Chovnick, A. (1994). Meiotic gene conversion tract length distribution within the rosy locus of *Drosophila melanogaster*. Genetics 137, 1019–1026.

Hulbert, S. H., Webb, C. A., Smith, S. M., and Sun, Q. (2001). Resistance gene complexes: evolution and utilization. Annu Rev Phytopathol 39, 285–312.

Jones, K. T., and Whittingham, D. G. (1996). A comparison of sperm- and IP3-induced Ca2+ release in activated and aging mouse oocytes. Dev. Biol. 178, 229–237.

Kawchuk, L. M., Hachey, J., Lynch, D. R., Kulcsar, F., van Rooijen, G., Waterer, D. R., Robertson, A., Kokko, E., Byers, R., Howard, R. J., Fischer, R., and Prufer, D.

(2001). Tomato Ve disease resistance genes encode cell surface-like receptors. Proc Natl Acad Sci USA 98, 6511–6515.

Kobe, B., and Kajava, A. V. (2001). The leucine-rich repeat as a protein recognition motif. Curr Opin Struct Biol 11, 725–732.

Liao, D., Pavelitz, T., Kidd, J. R., Kidd, K. K., and Weiner, A. M. (1997). Concerted evolution of the tandemly repeated genes encoding human U2 snRNA (the RNU2 locus) involves rapid intrachromosomal homogenization and rare interchromosomal gene conversion. Embo J 16, 588–598.

Lupas, A. (1997). Predicting coiled-coil regions in proteins. Curr Opin Struct Biol 7, 388–393.

Martin, G. B., Brommonschenkel, S. H., Chunqongse, J., Frary, A., Ganal, M. W., Spivey, R., Wu, T., Earle, E. D., and Tanksley, S. D. (1993). Map-based cloning of a protein kinase gene conferring disease resistance in tomato. Science 262, 1432–1436.

Meyers, B. C., Shen, K. A., Rohani, P., Gaut, B. S., and Michelmore, R. W. (1998). Receptor-like genes in the major resistance locus of lettuce are subject to divergent selection. Plant Cell 10, 1833–1846.

Michelmore, R. W., and Meyers, B. C. (1998). Clusters of resistance genes in plants evolve by divergent selection and a birth-and-death process. Genome Res. 8, 1113–1130.

Pan, Q., Wendel, J., and Fluhr, R. (2000). Divergent evolution of plant NBS-LRR resistance gene homologues in dicot and cereal genomes. J Mol Evol 50, 203–213.

Parniske, M., Hammond-Kosack, K. E., Golstein, C., Thomas, C. M., Jones, D. A., Harrison, K., Wulff, B. B., and Jones, J. D. (1997). Novel disease resistance specificities result from sequence exchange between tandemly repeated genes at the Cf-4/9 locus of tomato. Cell 91, 821–832.

Polzin, K. M., Lorenzen, L. L., Olson, T. C., and Shoemaker, R. C. (1994). An unusual polymorphic locus useful for tagging Rps 1 resistance alleles in soybean. Theor. Appl. Genet. 89, 226–232.

Richly, E., Kurth, J., and Leister, D. (2002). Mode of amplification and reorganization of resistance genes during recent *Arabidopsis thaliana* evolution. Mol Biol Evol 19, 76–84.

Schenk, P. M., Kazan, K., Wilson, I., Anderson, J. P., Richmond, T., Somerville, S. C., and Manners, J. M. (2000). Coordinated plant defense responses in *Arabidopsis* revealed by microarray analysis. Proc Natl Acad Sci USA 97, 11655–11660.

Schmitthenner, A. F. (1989). *Phytophthora* rot. In Compendium of soybean diseases, J. B. Sinclair and P. A. Backman, eds (St. Paul, Minn.: APS Press), pp. 35–38.

Semple, C., and Wolfe, K. H. (1999). Gene duplication and gene conversion in the *Caenorhabditis elegans* genome. J Mol Evol 48, 555–564.

Traut, T. W. (1994). The functions and consensus motifs of nine types of peptide segments that form different types of nucleotide-binding sites. Eur J Biochem 222, 9–19.

Vaucheret, H., and Fagard, M. (2001). Transcriptional gene silencing in plants: targets, inducers and regulators. Trends Genet 17, 29–35.

Whitham, S., Dinesh-Kumar, S. P., Choi, D., Hehl, R., Corr, C., and Baker, B. (1994). The product of the tobacco mosaic virus resistance gene N: Similarity to toll and the interleukin-1 receptor. Cell 78, 1101–1115.

Wrather, J. A., Anderson, T. R., Arsyad, D. M., Gai, J., Ploper, L. D., Porta-Puglia, A., Ram, H. H., and Yorinori, J. T. (1997). Soybean disease loss estimates for the top 10 soybean producing countries in 1994. Plant Dis. 81, 107–110.

Zhang Z., Xing A, Staswick P., Clemente T. (1999). The use of glufosinate as a selective agent in *Agrobacterium*-mediated transformation of soybean. Plant Cell Tissue Organ Cult. 56, 37–46.

Example 3

Recognition in Disease resistance: Several plant disease resistance genes that follow the classical gene-for-gene hypothesis (Flor, 1955) have been cloned. These genes can be classified into four major groups based on the structures of their protein products: (i) proteins with kinase activity, e.g., Pto and Rpg1 (Martin et al., 1993; Brueggeman et al., 2002); (ii) proteins with nucleotide binding sites (NBS) and leucine rich repeat regions (LRR), e.g., RPS2, N, L6, RPM1, Prf, M, I2, and RPP5 (Anderson et al., 1997; Bent et al., 1994; Grant et al., 1995; Lawrence et al., 1995; Mindrinos et al., 1994; Ori et al., 1997; Parker et al., 1997; Salmeron et al., 1996; Whitham et al., 1994); (iii) proteins with leucine-rich repeat regions and a transmembrane domain, e.g., Cf2, Cf4, and Cf9 (Dixon et al., 1996; Jones et al., 1994; Thomas et al., 1997) and (iv) proteins with leucine-rich repeat regions, a transmembrane, and serine/threonine kinase domains, e.g., Xa21 (Song et al., 1995). The group carrying genes with NBS and LRR motifs can be subdivided into two subgroups: (a) TIR NBS-LRR genes that carry an N-terminal TIR domain with homologies to Toll receptor of *Drosophila* and interleukin-1R receptor of mammals, and (b) C-C TIR NBS-LRR genes that carry coiled-coil domain at the N-terminus (Meyers et al., 1999). Most of the disease resistance genes cloned recently belongs to the C-C NBS-LRR group, which includes genes that confer resistance to viruses, bacteria, fungi, oomycetes, nematodes, and aphids. TIR NBS-LRR-type genes are most likely absent in the Poaceae (Meyers et al., 1999; Pan et al., 2000).

Cloning of resistance genes and their corresponding avirulence genes allowed us to test the Flor's gene-for-gene hypothesis (Flor, 1955). Interactions between products of resistance genes and those of corresponding avirulence genes do occur in vivo (Jia et al., 2000; Kim et al. 2002; Leister et al., 1996a; Scofield et al., 1996; Tang et al., 1996). Characterization of several resistance genes for allelic variations indicated that the LRR domain is the most-variable part of resistance genes, and the predicted solvent-exposed residues of the LRR region are subjected to diversifying selection. This implies that this diversified region of LRR is most likely involved in specific binding of pathogen-derived ligand (Ellis et al., 1999; Meyers et al., 1998; Parniske et al., 1997). The in vivo interaction between AvrPita from *Magnaporthe grisea* and LRR domain of Pi-ta from rice supports this conclusion (Jia et al., 2000). Non-LRR regions could also be important in determining race-specificity. For example, evidence supporting the diversifying selection for TIR domains of L alleles in flax has been reported (Luck et al., 2000). Contrary to the possible role of LRR domain in ligandbinding, genetic data showed that LRR domain may have a role in signal transduction (Warren et al., 1998).

Signal Transduction in Disease Resistance: Genetic as well as molecular genetic approaches have been applied to dissect the signal pathway involved in the expression of gene-specific resistance. Genetic screening of mutagenized populations has had limited success in identifying mutants for the signal transduction components. This could be due to the presence of multiple or redundant components in this pathway. Alternatively, such components are essential for viability. Extensive mutantscreening in several laboratories identified a few signal transduction mutants. They are: i) rar1 and rar2 of barley (Jorgensen 1988) rcr1, rcr2, rcr3, and prf in tomato (Dixon et al., 2000; Hammond-Kosack et al., 1994; Salmeron et al., 1994); ndr1, eds1, pbs1, pbs2, and pbs3 in *Arabidopsis* (Century et al., 1995; Parker et al., 1996; Warren et al., 1999). rar mutations in barley affect the expression of several powdery mildew-resistance genes (Freialdenhoven et al., 1994; Jorgensen 1996). Rar1 has been cloned and shown to function upstream of $H_2O_2$ accumulation in infected cells. Silencing of the Rar1 homologue in *Caenorhabditis elegans* resulted in both reduced fecundity and increased embryo mortality, suggesting essential function of the Rar1 homologue in nematodes. It has been proposed that Rar1 plays an essential cellular function. rar1 and rar2 are most unlikely null mutants. Possibly only the subfunction of Rar1 required for disease resistance and cell death is mutated in rar1 (Shirasu et al., 1999). *Arabidopsis* rar1 mutants, however, indicate that the *Arabidopsis* ortholog of barley Rar1 does not play a fundamental role in plant development (Muskett et al., 2002). Rcr1 and Rcr2 are shown to require Cf9 and Rcr3 for Cf2-specific resistance against *Cladosporium fulvum* (Dixon et al., 2000; Hammond-Kosack et al., 1994). Identification of four independent rcr3 mutant alleles indicated the saturation in mutant screening (Dixon et al., 2000). The Prf gene has been cloned and is a member of the C-C NBS-LRR class of resistance genes. It is required for the function of Pto and Fen. The Fen gene confers sensitivity to the insecticide fenthion (Salmeron et al., 1994; 1996).

The ndr1 mutant of *Arabidopsis* shows loss of resistance against bacterial pathogens *Pseudomonas* conferred by the C-C NBS-LRR resistance genes such as RPS2, RPM1 and RPS5, while eds1 mutants show loss of resistance against the oomycete pathogen *Peronospora parasitica* conferred by the TIR NBS-LRR resistance genes such as RPP2/4/5/21 genes (Aarts et al., 1998; Century et al., 1995). This suggests independent down-stream signal pathways for two classes of NBS-LRR genes and also the importance of N-terminal regions of NBS-LRR genes in signaling. Both NDR1 and EDS1 were cloned. NDR1 is most likely a membrane-associated protein with unknown function, while EDS1 shows a homology to eukaryotic lipases (Century et al., 1997; Falk et al., 1999). pbs1, pbs2, and pbs3 are *Arabidopsis* mutants that show loss of RPS5-specific resistance against *Pseudomonas syringae*. The pbs1 mutant affects only RPS5-specific resistance. On the other hand, pbs2 affects the expression of resistance conferred by RPS5 and RPM1, while pbs3 partially suppresses RPS5/2/4, RPM1 and RPP (Warren et al., 1999). PBS1 encodes a putative serine-threonine kinase (Swiderski and Innes 2001).

A yeast two-hybrid system has successfully been applied in isolating signal transducing pathway genes for defense gene expression regulated by tomato Pto (Sessa and Martin 2000; Bogdanove and Martin, 2000). A novel protein At-RSH1 showing a high identity to *Escherichia coli* RelA and SpoT proteins for the stringent response, analogous to the stress-induced defense system in plants, has been shown to interact with the NBS-ARC domain of the TIR NBS-LRR-type resistance gene RPP5 in a yeast two-hybrid system (van der Biezen et al., 2000).

In soybean, the Rps1-k-specific resistance against *P. sojae* race 4 and 7, but not against race 1, is significantly compromised in the ethylene mutant etr1 indicating more than one *Phytophthora* resistance gene in the Rps1-k locus, one of which requires a member of the ethylene-signal pathway for expression of *Phytophthora* resistance (Hoffman et al., 1999).

Soybean—*Phytophthora sojae* interaction: Soybean [*Glycine max* L. (Merrill)] is a major oil seed crop and is grown throughout much of the world. The United States alone produces over half of the world output. Soybean seed typically contains 40% protein and 20% oil. It is used primarily for livestock feed and industrial purposes, in addition to human consumption. In North America, soybean suffers yield loss from the root and stem rot disease caused by *P. sojae*. The annual yield loss of soybean from this disease in the United States was valued at about 120 million dollars (Wrather et al., 1997). Monogenic resistance encoded by Rps genes has been providing the soybean crop a reasonable protection against this pathogen for the last four decades. There are several physiological races of this fungal pathogen. The number of races is increasing rapidly. Schmitthenner and his co-workers (1994) concluded that *P. sojae* is a highly variable pathogen that exists in the soil as a wide variety of virulence phenotypes to which most Rps genes are ineffective. They also concluded that unless new Rps genes are identified or existing Rps genes are pyramided in single cultivars, resistance available in the present day cultivars might not be effective in controlling the disease in future.

At present, there are 14 Rps genes that confer race-specific resistance in soybean to different physiological races of *P. sojae* (Anderson and Buzzell, 1992; Polzin et al., 1994; Schmitthenner, 1989; Burnham et al. 2003). The genetics of resistance conferred by Rps genes is well established. Genetics of most of the avirulence genes (Avr) from *P. sojae* have also been reported (Tyler et al., 1995; Whisson et al., 1994; 1995). The interactions between 14 Rps genes with the corresponding Avr genes follow the 'gene-for-gene' hypothesis.

The soybean-*P. sojae* interaction is probably one of the most extensively studied host-pathogen interactions (Graham, 1995; Keen and Yoshikawa, 1990; Paxton, 1995; Ward, 1990). Inoculation of etiolated hypocotyls or roots with zoospore suspensions of *P. sojae* revealed that 3 to 4 h following inoculation host cells associated with the penetrated hyphae remain viable and healthy in the compatible interaction, but not in the incompatible interaction (Enkerli et al., 1997; Ward et al., 1989). The major differences between the two interactions were related to timing of the host responses. The phytoalexin glyceollin accumulates to a significantly high level 8 h after inoculation in the incompatible interaction, but only after 12 h in the compatible interaction (Bhattacharyya and Ward, 1986a). The rapid induction of defense compounds such as glyceollin resulted from the transcriptional activation of genes of the phenylpropanoid pathway. Some of the key enzymes and genes of this pathway are activated within 3 h following inoculation in the resistant response (Bhattacharyya and Ward, 1988; Ebel and Grisebach, 1988; Esnault et al., 1987). Recently we have cloned the Rps1-k gene family and showed that there are at least two functional genes in the Rps1-k locus. These genes will allow us to study the objectives proposed for understanding the molecular basis of the soybean-*Phytophthora* interaction.

Identification of the Rps1-k gene through complementation analysis: Rps1-k was mapped to a region physically spanned by three overlapping bacterial artificial chromosomes (BAC), BAC18, BAC43, and BAC99 (Bhattacharyya et al., 2003). Five highly identical coiled-coil NBS-LRR-type genes were identified by subcloning and sequencing of these three BACs. The genes were grouped into two classes, each carrying either two or three identical genes. Open reading frames (ORFs) of members of the Rps1-k gene family share 93–100% nucleotide and 89.9–100% amino acid sequence identity and carry no introns. One hundred and five variable positions, aside from 3 deletions of 1, 2, and 21 amino acids were identified in ORFs. Thirty-four variable positions were found at the N terminus (C-C motif and NBS domain) and 71 at the C terminus (LRR domain) of the protein. Only two alternative residues were found in all variable positions. These variable positions or informative polymorphic sites (IPSs) allowed us to group five genes into two distinct classes of identical genes. There are three deletions in the 5'-end region, and 6 and 84 IPSs at the 5'- and 3'-end regions, respectively (FIG. 14 of example 2).

Three genes, Rps1-k-1, -3, and -5, with identical ORFs represent one class, whereas Rps1-k-2 and Rps1-k-4 represent the other. Rps1-k-1 and -5 are identical genes but were cloned from nonoverlapping BAC18, and 99. Rps1-k-3 is a unique gene, because a recombination breakpoint was identified at its 3'-end region between 302 and 478 nucleotides (nts) downstream from the stop codon. Rps1-k-2 and -4 were distinguished by a single nt deletion in Rps1-k-2 at position 1900 nts downstream from the stop codon. Identical sequences among genes isolated from about 300 kb contiguous DNA of the Rps1-k locus made it difficult to identify all members of the gene family. We conclude that at least five genes are located at the Rps1-k locus. There are about 33 additional copies of the gene family next to the BAC18 side of the Rps1-k locus and were not studied, because a recombination event separated these genes from the Rps1-k locus. (Bhattacharyya et al., 2002).

To establish the functional identity, two members Rps1-k-2 and -3, one from each class, were introduced into soybean cv. Williams 79 (Rps1-c/Rps1-c) through *Agrobacterium*-mediated transformation procedures (Zhang et al., 1999b; in collaboration with Dr. K. Wang). $R_1$ progeny populations of five independent $R_o$ plants for Rps1-k-2 and three for Rps1-k-3 were evaluated by leaf and root inoculation procedures. Progenies of only one out of five independent transgenic plants carrying Rps1-k-2 showed *Phytophthora* resistance, while progenies of all three independent transgenic plants carrying Rps1-k-3 expressed resistance.

Influence of Rps1-k in the global gene transcription through a signal pathway(s) in conferring broad-spectrum resistance: We are interested in studying whether overexpression of Rps1-k results in broad-spectrum resistance against four selected diverse pathogens through activation of a single signal-transduction pathway.

Generation of transgenic soybean plants: Transcripts of the Rps1-k gene family are very rare. Screening of over four million independent lambda clones carrying cDNAs prepared from uninfected etiolated hypocotyls resulted in isolation of only four cDNAs. To discover genes that are regulated by an Rps1-k-activated signal pathway, Rps1-k will be overexpressed in stable transgenic plants. Overexpression of resistance genes has been shown to activate defense mechanisms and broadspectrum resistance (e.g. Tang et al., 1999). Transgenic soybean lines will be generated by transforming the susceptible cultivar Williams (rps1-k) with Rps1-k-3, regulated by either the cauliflower mosaic virus (CaMV) 35S promoter, or an alcohol inducible promoter (alc) (Roslan et al., 2001). Vector control plants will include transgenic plants carrying only either the alcohol inducible promoter, or the CaMV35S promoter. In *Arabidopsis* it has been shown that 2% alcohol was optimal for the maximum activity of the alc-promoter that was fused to the GUS gene (Roslan et al., 2001). Alcohol at a similar concentration is also expected to activate the alc-promoter in soybean. We investigated if alcohol affects the expression of *Phytophthora* resistance encoded by Rps1-k. Alcohol at varying concentrations was fed through roots of two-week old seedlings for 16 hours before inoculation. At high concentrations, alcohol made soybean plants more susceptible to *P. sojae* in the absence of Rps1-k. However, the expression of Rps1-k-encoded resistance was not affected by the treatment with 5% alcohol (FIG. 13). The mechanism of this alcohol-induced susceptibility is unknown. The results indicate that the alc-promoter should be applicable to overproduce Rps1-k because the resistant response is stable even with 5% alcohol treatment.

In addition to the promoter fusion approach described above transgenic plants carrying all five Rps-1-k genes under their own promoters are being generated in Williams. Evaluation of a large collection of transgenic plants carrying members of the Rps1-k gene family is expected to result in at least a single transgenic plant that may carry a higher level of Rps1-k transcripts than that in the nontransgenic wild-type cultivar Williams 82 (Rps1-k). Integration of transgenes into transcriptionally active regions is thought to cause enhanced transcript accumulation. Broad-spectrum resistance developed from overexpression of the Prf gene in transgenic tomatoes resulted from this phenomenon (Oldroyd and Staskawicz, 1998). We expect to observe similar results from overexpression in transgenic soybeans. During the analysis of $R_1$ plants (Table 1) we identified three individual plants that showed much smaller lesions than those of Williams 82 (FIG. 14). $R_2$ progenies of these plants are currently being grown and will be evaluated for disease phenotypes and Rps1-k-2 and -3 transcript levels. If these $R_2$ plants show an immune-type response like that in $R_1$s, they will be evaluated for broad-spectrum resistance against selected pathogens.

FIG. 13. Lesion development following feeding of soybean seedlings with ethanol. Data were taken 72 h following inoculation. S, Williams inoculated with *P. sojae* race 1;

Functional genomics of the soybean-*Phytophthora sojae* interaction.

We are interested in investigating the changes in gene expression that occur almost immediately following infection. The progression of disease development in etiolated tissues following inoculation with *P. sojae* zoospores is extremely rapid and one can detect accumulation of phytoalexins glyceollin isomers by 8 h following inoculation only in the resistant response not in the susceptible response (Bhattacharyya and Ward 1986a). Genes involved in the synthesis of glyceollin or other putative defense responses are induced by as early as 2½ h following infection (Esnault et al., 1987; Liu et al., 2001). A cDNA library (Gm-c1084) was constructed from equal amounts of poly($A^+$) RNAs isolated from 2 to 4 h following inoculation of etiolated Williams 82 hypocotyls with *P. sojae* race 1 zoospores. In collaboration with Dr. Randy Shoemaker, Iowa State University, we have sequenced this cDNA library (www.129.186.26.94/sobybean%20EST/libraries/Gm-c1084.html). Over six thousands cDNA clones were selected and sequenced, and 4737 ESTs were deposited in the GenBank.

ESTs isolated from the Gm-c1084 library were compared with 152,000 ESTs isolated from unstressed soybean cDNA libraries and we identified 227 unique genes that were only found in the Gm-c1084 library. Presumably these genes are not transcribed in uninfected or unstressed tissues (D. Grant, R. C. Shoemaker and M. K. Bhattacharyya, unpublished). To validate the expression of these 227 genes in infected tissues, DNA samples were prepared by a Montage Kit supplied by Millipore, Inc. (Bedford, Mass.) and DNA from each EST clone was spotted twice onto nylon membranes. Reverse transcribed radiolabeled cDNAs prepared from uninfected and infected tissues were then used to hybridize these EST clones spotted on nylon membranes. This experiment is in progress. Gm-c1084 library-specific clones will be included in the set of unigenes used for preparing microarrays of soybean EST sequences in the Vodkin Laboratory.

FIG. 14. Immune responses shown by R1 progenies. a. Williams 82 (Rps1-k) trifoliates showing normal resistant response. b and d, trifoliates from two independent $R_1$ plants of an $R_o$ plant ST20-S1-1-1B carrying Rp1-k-3. c, trifoliates from the $R_o$ plant ST22-S1-37C carrying Rp1-k-2. Arrows are used to show poor HR development among transgenic plants.

The rationale of the proposed research is that once it is known how the expression of resistance of soybean against its pathogens takes place, engineering of broad-spectrum resistance will be feasible, and thus, productivity of soybeans will increase without the use of toxic pesticides. Understanding of the signal transduction process and its components is very central to achieving this goal.

The signal pathway involved in disease resistance can be understood by studying the Rps1-k-overexpressed plants. Overexpression of the disease resistance gene Rps1-k is expected to activate a common signal pathway that alters the global gene expression and induces broad-spectrum resistance against soybean pathogens. Changes in the global gene transcription in Rps1-k-overexpressed transgenic soybean plants are expected to identify downstream novel pathways or genes that are important for induction of the broad-spectrum resistance.

As stated earlier, the annual yield loss of soybean in the United States from the *Phytophthora* root and stem rot disease is valued at about 120 million dollars and from all diseases and pests together at nearly one billion dollars (Wrather et al., 1997). The proposed research is significant, because it will advance our knowledge of the signal transduction process in the expression of resistance against *P. sojae* and other pathogens and will contribute significantly towards generating broad-spectrum resistance. This research will lead to cloning of genes involved in signal transduction for expression of defense compounds and also novel genes involved in the expression of resistance. Manipulation of these genes in transgenic soybean plants and their corresponding orthologous genes in other crop species should generate broad-spectrum resistance against plant pathogens. Collectively, the research proposed in this application is very significant, because it is expected to contribute towards engineering broad-spectrum resistance to many soybean pathogens, which will mean greater profitability for the soybean farmers and cleaner environment. The knowledge obtained in this investigation should be applicable to other host-pathogen interactions in generating broad-spectrum resistance against serious diseases of agronomic importance.

The proposed research, therefore, is expected to have a significant positive effect on agriculture, because it has the potential of saving hundreds of millions of dollars in annual crop losses due to diseases and resulting in a cleaner environment; and, therefore, will contribute significantly to the long-term sustainability of U.S. agriculture.

We are in the process of developing transgenic lines carrying Rps1-k-3 under the control of either the strong constitutive 35S promoter or an alcohol inducible promoter. $R_1$ progenies of these transgenic plants will be analyzed for transcripts and homozygous $R_2$ progenies (Rps1-k-3, Rps1-k-3) for the extent of broad-spectrum resistance. We have recently harvested a limited number of $R_2$ seeds from the complemented transgenic lines showing immune-type responses (FIG. 14). These plants will be evaluated for transcript levels of the transgene and also for the extent of broad-spectrum resistance against *P. sojae* races. Currently we are also generating additional transgenic lines carrying all five members of the Rps1-k gene family, and $R_1$ progeny of those transgenic plants will be evaluated in 2003. If we fail to reach our goal from promoter-gene fusion experiments described above or plants shown in FIG. 14, progenies of these lines carrying individual members of the gene family will be evaluated for broad-spectrum resistance. The working hypothesis for this objective is that overexpression of an Rps1-k gene will change the global gene transcription pattern for inducing broad-spectrum resistance against soybean pathogens.

Experimental Design

Development of transgenic lines and analysis of transcript levels for Rps1-k: Ten independent transgenic Williams lines will be generated for Rps1-k-3 under control of either the strong constitutive promoter CaMV35S, or an alcohol-inducible promoter. Northern blot analysis and/or RT-PCR experiments will be carried out to determine the Rps1-k-3 transcript levels among the transgenic $R_1$ lines. $R_2$ homozygous progenies of the R1 lines showing high Rps1-k-3 transcript levels will be evaluated along with proper vector control plants for the extent of broad-spectrum resistance against *P. sojae* races and three other soybean pathogens: soybean mosaic virus (SMV), *Pseudomonas syringae* pv. *glycinea* (Psg), and soybean cyst nematodes (SCN). The transgenic lines showing broad-spectrum resistance will then be evaluated for changes in the pattern of global gene transcription and biochemical traits that may be involved in the expression of disease resistance. Transgenic soybean plants will be analyzed by Southern blot analysis to estimate the number of integrated transgene copies.

Extent of broad-spectrum resistance against soybean pathogens: $R_2$ transgenic lines showing elevated levels of the Rps1-k-3 transcript will be evaluated for the extent of induced resistance against virulent races or isolates of *P. sojae*, SMV, Psg, and SCN. The level of resistance in three homozygous $R_2$ families (Rps1-k-3, Rps1-k-3) descended from three independent $R_o$ plants will be compared to that of the $R_2$ families of vector transformed control plants. We will collaborate with Dr. J. Hill to screen these plants for SMV resistance while with Dr. G. Tylka for SCN resistance.

Resistance to *Phytophthora sojae* races: Hypocotyls of 20 etiolated seedlings and unifoliate leaves of five seedlings from each homozygous $R_2$ family will be inoculated with zoospores of race 25 that is virulent against Williams 82 (Rps1-k) (Bhattacharyya and Ward 1986b; Ward et al., 1979). Root inoculation will be carried out by germinating 10 seeds in coarse vermiculites 1–1.5 cm above a layer of virulent *P. sojae* race 25, grown in diluted V8 agar plates for two weeks. Susceptible seedlings fail to grow in this assay. Levels of resistance in hypocotyls or leaves will be expressed as inverse of percent lesion length/day over that in vector control transgenic plants. For root assay it will be expressed in percent stem length/day over that in vector control transgenic plants. Resistance to *Pseudomonas syringae* pv. *glycinea:*

Bacterial blight disease caused by Psg is a foliage disease; and soybean can be protected effectively by growing resistant cultivars. There are at least four resistance genes (Rpg) that confer race-specific resistance against Psg (Keen and Buzzell 1991). Inoculation of unifoliate leaves from 10 seedlings of each $R_2$ family will be carried out using a Psg strain that is virulent against the cultivar Williams and levels of resistance will be expressed as inverse of percent lesion length/day over that in vector control transgenic plants (Keen and Buzzell 1991).

Resistances to Soybean Mosaic Virus:

SMV is one of the common diseases of soybean that causes yield reduction and seed-quality deterioration. Growing resistance cultivars has been considered to be the most effective method of controlling this pathogen. Resistance is conferred by single genes (Rsv) that are SMV strain-specific. Rsv1 has been mapped and NBS-LRR-type resistance gene sequences tightly linked to this gene have been identified (Yu at al. 1996; Gore et al., 2002). Hill Lab, Iowa State University, developed an immunocapture reverse transcription polymerase chain reaction (Ag-RT/PCR) method for SM. It is highly sensitive and quantitative and will be used in determining the extent of SMV spread in infected soybean plants (Nolasco et al., 1993). Inoculation of leaves from 10 seedlings of each $R_2$ family with a SMV strain virulent to Williams will be carried out in collaboration with Dr. Hill. Broad-spectrum resistance of the selected $R_2$ lines will be expressed as inverse of percent RT-PCR product amounts over that in vector control transgenic plants. Real-time RT-PCR will be carried out for accurate determination of the virus transcripts.

Resistance to Soybean Cyst Nematodes:

SCN (*Heterodea glycines*) is regarded as the most damaging pathogen of soybean, causing annual crop losses of over 300 million dollars (Doupnik, 1993; Wrather et al., 1997). SCN is a soil-born pathogen. In the soil, nematode eggs undergo embryogenesis and develop through one molt into second stage juveniles, which hatch and migrate through the soil in search of susceptible plants. Resistance of soybean to SCN has been shown to offer great promise in reducing crop losses from SCN. Twenty seedlings from each $R_2$ family will be evaluated for resistance against a SCN race that is virulent against Williams and quantified according to the method of Schmitt and Shannon (1992) and expressed as inverse of percent galls formed over that in vector control plants.

Characterization of Transgenic Lines for Global Gene Transcription and Other Cellular and Metabolic Changes:

We will characterize transgenic lines with high Rps1-k transcript levels and broad-spectrum resistance for changes in i) the pattern of global gene transcription, ii) phenotypes at the cellular or tissues levels, and iii) metabolites that are considered as signal transducing effectors.

Global gene regulation will be studied for transgenic lines with the highest level of Rps1-k transcripts and broad-spectrum resistance. To date, 301,734 soybean ESTs are available in GenBank and 9,216 unigenes have been identified (L. Vodkin, personal communication). The publicly funded soybean EST project has allowed us to sequence the Gm-c1084 cDNA library, constructed from the incompatible soybean-*P. sojae* interaction. Microarray analysis will be carried out in collaboration with Dr. L. Vodkin, University of Illinois. Methods for microarray analysis have been established (www.soybeangenomics.cropsci.uiuc.edu/protocols/index.html). To date, microarrays carrying 9,216 unigenes (www.soybeangenomics.cropsci.uiuc.edu/files/NSF Web Overview.pdf) are available at the Vodkin Lab. It is expected that Vodkin lab will be in a position to print DNA microarrays containing approximately 30,000 unique genes, including those from the Gm-c 1084 cDNA library, by the summer of 2003 (Vodkin, personal communication) and will be used for the following treatments: (i) *P. sojae* race 1 infected transgenic $R_2$ Williams (Rps1-k-3) plants showing broad-spectrum resistance; (ii) water control for the transgenic $R_2$ Williams (Rps1-k-3) plants showing broad-spectrum resistance; (iii) *P. sojae* race 1 infected vector-transformed $R_2$ Williams (rps1-k) plants; (iv) water control for the vector-transformed $R_2$ Williams (rps1-k) plants; (v) *P. sojae* race 1 infected transgenic $R_2$ Williams (Rps1-k-3) plants showing only the Rps1-k-3-specific phenotype; (vi) water control for transgenic $R_2$ Williams (Rps1-k-3) plants showing only the Rps1-k-specific phenotype.

Poly($A^+$) RNAs for microarray analyses will be prepared from etiolated hypocotyl tissues harvested 4 h following either treatment with water droplets or inoculated with *P. sojae* race 1 zoospore suspensions (Bhattacharyya, 2001; Ward et al., 1979). Probes will be prepared from poly($A^+$) RNAs and hybridized to microarrays in the Vodkin Lab. Three independent experiments will be conducted to eliminate any experimental variation. Images will be quantified with software packages such as Scanalyse or GenePix, which are in use at the University of Illinois and Iowa State University. An inherent part of this gene expression analysis is the within-slide variability in incorporation and/or detection of fluorescent probe in the hybridization process. The Vodkin Lab has developed a procedure for normalization of array data that simultaneously corrects itself for sources of variation using an analysis of variance approach. Microarray analysis data will be validated by carrying out reverse northern or northern blot analyses for 30 randomly selected genes.

Changes in phenotypes at the cellular or tissue level will be determined through microscopic analyses of the transgenic plants for cell death or accumulation of autofluorescent compounds. Any changes in autofluorescent materials will be determined by following standard procedures (Dietrich et al., 1994; Shigaki and Bhattacharyya, 2000).

Levels of salicylic acid content, the signal molecule for systemic acquired resistance, will be determined according to protocol described by Bowling et al., (1994).

Over-expression of Rps1-k-3 is expected to induce broad-spectrum resistance by eliciting a signal pathway(s) that regulates gene transcription involved in enhancing the accumulation of products that are shown to be associated with the expression of resistance. Microarray analysis should characterize alterations in global gene transcription associated with the expression of broad-spectrum resistance. Thus, the analysis of global gene transcription and determination of levels of candidate metabolites among Rps1-k overexpressed plants will result in a better understanding of the extent to which a common signal pathway influences the expression of defense responses against a wide array of pathogens.

Transgenic soybean lines showing varying levels of Rps1-k transcripts will be developed. Increased Rps1-k transcripts are expected to induce defense through the signal pathway and to result in broad-spectrum resistance against the four diverse pathogens. This will establish that a single signal pathway is involved in the expression of resistance against diverse pathogens. Lines with broad-spectrum resistance will be utilized to investigate the extent of changes in global gene transcription due to overproduction of Rps1-k.

This functional genomics approach will assist to understand the metabolic pathways that are altered in conferring broad-spectrum resistance. Such information is important to better understand the mechanisms of disease resistance. Novel genes identified in the functional genomics study could be utilized in developing improved soybean germplasm.

REFERENCES

Aarts, N., Metz, M., Holub, E., Staskawicz, B. J., Daniels, M. J., and Parker, J. E. 1998. Different requirements for EDS1 and NDR1 by disease resistance genes define at least two R gene-mediated signaling pathways in *Arabidopsis*. Proc Natl Acad Sci USA. 95:10306–10311.

Anandalakshmi, R., Pruss, G. J., Ge, X., Marathe, R., Mallory, A. C., Smith, T. H., and Vance, V. B. 1998. A viral suppressor of gene silencing in plants. Proc Natl Acad Sci USA. 95:13079–13084.

Anderson, P. A., Lawrence, G. J., Morrish, B. C., Ayliffe, M. A., Finnegan, E. J., and Ellis, J. G. 1997. Inactivation of the flax rust resistance gene M associated with loss of a repeated unit within the leucine-rich repeat coding region. Plant Cell 9:641–651.

Anderson, T. R., and Buzzell, R. I. 1992. Inheritance and linkage of the Rps7 gene for resistance to *Phytophthora* rot of soybean. Plant Disease 76:958–959.

Azevedo, C., Sadanandom, A., Kitagawa, K., Freialdenhoven, A., Shirasu, K., Schulze-Lefert, P. 2002. The RAR1 interactor SGT1, an essential component of R gene-triggered disease resistance. Science 295:2073–2076.

Bhattacharyya M. K., Narayanan N. N., Salimath S. S., Santra D. Gao H., Ellison L, Kasuga, T., Liu Y., Espinosa B., Marek L. F., Shoemaker R. C., Gijzen M. and Buzzell R. I. 2003. Positional cloning and organization of members of the Rps1-k gene family in soybean. Genetics, to be resubmitted.

Bhattacharyya, M. K., and Ward, E. W. B. 1986a. Resistance, susceptibility and accumulation of glyceollins I–III in soybean organs inoculated with *Phytophthora megasperma* f.sp. *glycinea*. Physiological and Molecular Plant Pathology 29:227–237.

Bhattacharyya, M. K., and Ward, E. W. B. 1986b. Expression of gene-specific and age-related resistance and the accumulation of glyceollin in soybean leaves infected with *Phytophthora megasperma* f.sp. *glycinea*. Physiological and Molecular Plant Pathology 29:105–113.

Bhattacharyya, M. K., and Ward, E. W. B. 1988. Phenylalanine ammonia-lyase activity in soybean hypocotyls and leaves following infection with *Phytophthora megasperma* f.sp. *glycinea*. Canadian Journal of Botany 66:18–23.

Bent, A. F., Kunkel, B. N., Dahlbeck, D., Brown, K. L., Schmidt, R., Giraudat, J., Leung, J., and Staskawicz, B, J. 1994. RPS2 of *Arabidopsis thaliana*: a leucine-rich repeat class of plant disease resistance genes. Science 265(5180):1856–60.

Bogdanove, A. J., and Martin, G. B. 2000. AvrPto-dependent Pto-interacting proteins and AvrPto-interacting proteins in tomato. Proc Natl Acad Sci USA 97:8836–40.

Bowling, S. A., Guo, A., Cao, H., Gordon, A. S., Klessig, D. F., and Dong, X. 1994. A mutation in *Arabidopsis* that leads to constitutive expression of systemic acquired resistance. Plant Cell 6:1845–1857.

Brueggeman, R., Rostoks, N., Kudrna, D., Kilian, A., Han, F., Chen, J., Druka, A., Steffenson, B., and Kleinhofs, A. 2002. The barley stem rust-resistance gene Rpg1 is a novel disease-resistance gene with homology to receptor kinases. Proc Natl Acad. Sci. USA 99:9328–9333.

Burnham, K. D., A. E. Dorrance, D. M. Francis, R. J. Fioritto, and S. K. St. Martin. 2003. Rps8, a new locus in soybean for resistance to *Phytophthora sojae*. Crop Sci 43:101–105.

Cao, H., Li, X., and Dong, X. 1998. Generation of broad-spectrum disease resistance by overexpression of an essential regulatory gene in systemic acquired resistance. Proc Natl Acad. Sci. USA 95:6531–6536.

Century, K. S., Holub, E. B., and Staskawicz, B. J. 1995. NDR1, a locus of *Arabidopsis thaliana* that is required for disease resistance to both a bacterial and a fungal pathogen. Proc Natl Acad Sci. USA 92:6597–6601.

Century, K. S., Shapiro, A. D., Repetti, P. P., Dahlbeck, D., Holub, E., and Staskawicz, B. J. 1997. NDR1, a pathogen-induced component required for *Arabidopsis* disease resistance. Science 278:1963–1965.

Dietrich, R. A., Delaney, T. P., Uknes, S. J., Ward, E. R., Ryals, J. A., and Dangl, J. L. 1994. *Arabidopsis* mutants simulating disease resistance response. Cell 77:565–577.

Dixon, M. S., Golstein, C., Thomas, C. M., van Der Biezen, E. A., and Jones, J. D. 2000. Genetic complexity of pathogen perception by plants: the example of Rcr3, a tomato gene required specifically by Cf-2. Proc Natl Acad Sci USA 97:8807–8814.

Dixon, M. S., Jones, D. A., Keddie, J. S., Thomas, C. M., Harrison, K., and Jones, J. D. G. 1996. The tomato Cf-2 disease resistance locus comprises two functional genes encoding leucine-rich repeat proteins. Cell 84:451–459.

Doupnik, J., B. 1993. Soybean production and disease loss estimates for North Central United States from 1989 to 1991. Plant Disease 77:1170–1171.

Ebel, J., and Grisebach, H. 1988. Defense strategies of soybean against the fungus *Phytophthora megasperma* f.sp. *glycinea*: a molecular analysis. Trends Biochem Sci. 13:23–27.

Ellis, J. G., Lawrence, G. J., Luck, J. E., and Dodds, P. N. 1999. Identification of regions in alleles of the flax rust resistance gene L that determines differences in gene-for-gene specificity. Plant Cell 11:495–506.

Enkerli, K., Hahn, M. G., and Mims, C. W. 1997. Ultrastructure of compatible and incompatible interactions of soybean roots infected with the plant pathogenic oomycete *Phytophthora sojae*. Canadian J. Bot. 75:1493–1508.

Esnault, R., Chibbar, R. N., Lee, D., Van Huystee, R. B., and Ward, E. W. B. 1987. Early differences in production of mRNAs for phenylalanine ammonia-lyase and chalcone synthase in resistant and susceptible cultivars of soybean inoculated with *Phytophthora megasperma* f.sp. *glycinea*. Physiol. and Mol. Plant Pathol. 30:293–297.

Falk, A., Feys, B. J., Frost, L. N., Jones, J. D. G., Daniels, M. J., and Parker, J. E. 1999. EDS1, an essential component of R gene-mediated disease resistance in *Arabidopsis* has homology to eukaryotic lipases. Proc Natl Acad Sci. USA 96:3292–3297.

Flor, H. H. 1955. Host-parasite interaction in flax rust—its genetics and other implications. Phytopathology 45:680–685.

Frame, B. R., Shou, H., Chikwamba, R. K., Zhang, Z., Xiang, C., Fonger, T. M., Pegg, S. E., Li, B., Nettleton, D. S., Pei, D., and Wang, K. 2002. *Agrobacterium tumefaciens*-mediated transformation of maize embryos using a standard binary vector system. Plant Physiol. 129:13–22.

Freialdenhoven, A., Scherag, B., Hollricher, K., Collinge, D. B., Thordal-Christensen, H., and Schulze-Lefert, P. 1994.

Nar-1 and Nar-2, two loci required for Mla$_{12}$-specified race-specific resistance to powdery mildew in barley. Plant Cell 6: 983–994.

Gore, M. A., Hayes, A. J., Jeong, S. C., Yue, Y. G., Buss, G. R., Maroof, S. 2002. Mapping tightly linked genes controlling potyvirus infection at the Rsv1 and Rpv1 region in soybean. Genome 45:592–599.

Graham, T. L. 1995. Cellular biochemistry of phenylpropanoid responses of soybean to infection by *Phytophthora sojae*, p. 85–116, In M. Daniel and R. P. Purkayastha, eds. Handbook of phytoalexin metabolism and action. Marcel Dekker, New York.

Grant, M. R., Godiard, L., Straube, E., Ashfield, T., Lewald, J., Sattler, A., Innes, R. W., and Dangl, J. L. 1995. Structure of the *Arabidopsis* RPM1 gene enabling dual specificity disease resistance. Science 269:843–846.

Hammond-Kosack, K. E., Jones, D. A., and Jones, J. D. G. 1994. Identification of two genes required in tomato for full Cf-9-dependent resistance to *Cladosporium fulvum*. Plant Cell 6:361–374.

Hoffman, T., Schmidt, J. S., Zheng, X., and Bent, A. F. 1999. Isolation of ethylene-insensitive soybean mutants that are altered in pathogen susceptibility and gene-for-gene disease resistance. Plant Physiol. 119:935–949.

Jia, Y., McAdams, S. A., Bryan, G. T., Hershey, H. P., and Valent, B. 2000. Direct interaction of resistance gene and avirulence gene products confers rice blast resistance. EMBO 19:4004–4014.

Jones, D. A., Thomas, C. M., Hammond-Kosack, K. E., Balint-Kurti, P. J., and Jones, J. D. G. 1994. Isolation of the tomato Cf-9 gene for resistance to *Cladosporium fulvum* by transposon tagging. Science 266:789–793.

Jorgensen, J. H. 0.1988. Genetic analysis of barley mutants with modifications of powdery mildew resistance gene Mla-12. Genome 30: 129 132.

Jørgensen, J. H. 1996. Effect of three suppressors on the expression of powdery mildew resistance genes in barley. Genome 39: 492–498.

Kanazin, V., Marek, L. F., and Shoemaker, R. C. 1996. Resistance gene analogs are conserved and clustered in soybean. Proc Natl Acad Sci. USA 93:11746–11750.

Kasuga, T., Salimath, S. S., Shi, J., Gijzen, M., Buzzell, R. I., and Bhattacharyya, M. K. 1997. High resolution genetic and physical mapping of molecular markers linked to the *Phytophthora* resistance gene Rps1-k in soybean. Molecular Plant-Microbe Interactions 10:1035–1044.

Keen, N. T., and Yoshikawa, M. 1990. The expression of resistance in soya beans to *Phytophthora megasperma* f.sp. *glycinea*, p. 329–344, In D. Hornby, et al., eds. Biological Control of Soil-Borne Plant Pathogens. CAB International, Wallingford, Oxon, United Kingdom.

Keen, N. T., and Buzzell, R. I. 1991. New disease resistance genes in soybean against *Pseudomonas syringae* pv *glycinea*: evidence that one of them interacts with a bacterial elicitor. Theor Appl Genet 81:133–138.

Kim, Y. J., Lin, N. C., and Martin, G. B. 2002. Two distinct *Pseudomonas* effector proteins interact with the Pto kinase and activate plant immunity. Cell 109:589–598.

Lawrence, G. J., Finnegan, E. J., Ayliffe, M. A., and Ellis, J. G. 1995. The L6 gene for flax rust resistance is related to the *Arabidopsis* bacterial resistance gene RPS2 and the tobacco viral resistance gene N. Plant Cell 7:1195–1206.

Leister, R. T., Ausubel, F. M., and Katagiri, F. 1996b. Molecular recognition of pathogen attack occurs inside of plant cells in plant disease resistance specified by the *Arabidopsis* genes RPS2 and RPM1. Proc Natl Acad Sci. USA 93:15497–15502.

Liu, Y., Dammann, C. and Bhattacharyya, M. K. 2001. The matrix metalloproteinase gene GmMMP2 is activated in response to pathogenic infections in soybean. Plant Physiol. 127:1788–1797.

Luck, J. E., Lawrence, G. J., Dodds, P. N., Shepherd, K. W., and Ellis, J. G. 2000. Regions outside of the leucine-rich repeats of flax rust resistance proteins play a role in specificity determination. Plant Cell. 12:1367–1377.

Mallory, A. C., Parks, G., Endres, M. W., Baulcombe, D., Bowman, L. H., Pruss, G. J., and Vance, V. B. 2002. The amplicon-plus system for high-level expression of transgenes in plants. Nat Biotechnol. 20:622–625.

Martin, G. B., Brommonschenkel, S. H., Chunwongse, J., Frary, A., Ganal, M. W., Spivey, R., Wu, T., Earle, E. D., and Tanksley, S. D. 1993. Map-based cloning of a protein kinase gene conferring disease resistance in tomato. Science 262:1432–1436.

Meyers, B. C., Shen, K. A., Rohani, P., Gaut, B. S., and Michelmore, R. W. 1998. Receptor-like genes in the major resistance locus of lettuce are subject to divergent selection. Plant Cell 10:1833–1846.

Meyers, B. C., Dickerman, A. W., Michelmore, R. W., Sivaramakrishnan, S., Sobral, B. W., and Young, N. D. 1999. Plant disease resistance genes encode members of an ancient and diverse protein family within the nucleotide-binding superfamily. Plant Journal 20:317–332.

Mindrinos, M., Katagiri, F., Yu, G.-L., and Ausubel, F. M. 1994. The *A. thaliana* disease resistance gene RPS2 encodes a protein containing a nucleotide-binding site and leucine-rich repeats. Cell 78:1089–1099.

Muskett, P. R., Kahn, K., Austin, M. J., Moisan, L. J., Sadanandom, A., Shirasu, K., Jones, J. D., and Parker, J. E. 2002 *Arabidopsis* RAR1 exerts rate-limiting control of R gene-mediated defenses against multiple pathogens. Plant Cell 14:979–992.

Nolasco, G., de Blas, C., Torres, and V., Ponz, F. 1993. A method combining immunocapture and PCR amplification in a microtiter plate for the detection of plant viruses and subviral pathogens. *J Virol Methods* 45: 201–218.

Oldroyd, G. E. D., and Staskawicz, B. J. 1998. Genetically engineered broad-spectrum disease resistance in tomato. Proc Natl Acad Sci. USA 95:10300–10305.

Ori, N., Eshed, Y., Paran, I., Presting, G., Aviv, D., Tanksley, S., Zamir, D., and Fluhr, R. 1997. The I2C family from the wilt disease resistance locus I2 belongs to the nucleotide binding, leucine-rich repeat superfamily of plant resistance genes. Plant Cell 9:521–532.

Pan, Q., Liu, Y. S., Budai-Hadrian, O., Sela, M., Carmel-Goren, L., Zamir, D., and Fluhr, R. 2000. Comparative genetics of nucleotide binding site-leucine rich repeat resistance gene homologues in the genomes of two dicotyledons: tomato and *arabidopsis*. Genetics 155:309–322.

Parker, J. E., Holub, E. B., Frost, L. N., Falk, A., Gunn, N. D., and Daniels, M. J. 1996. Characterization of eds1, a mutation in *arabidopsis* suppressing resistance to *Peronospora parasitica* specified by several different RPP genes. Plant Cell 8:2033–2046.

Parker, J. E., Coleman, M. J., Szabó, V., Frost, L. N., Schmidt, R., van der Biezen, E. A., Moores, T., Dean, C., Daniels, M. J., and Jones, J. D. G. 1997. The *Arabidopsis* downy mildew resistance gene RPP5 shares similarity to the toll and interleukin-1 receptors with N and L6. Plant Cell 9:879–894.

Parniske, M., Hammond-Kosack, K. E., Golstein, C., Thomas, C. M., Jones, D. A., Harrison, K., Wulff, B. B. H., and Jones, J. D. G. 1997. Novel disease resistance specificities result from sequence exchange between tandemly repeated genes at the Cf-4/9 locus of tomato. Cell 91:821–832.

Paxton, J. 1995. Soybean phytoalexins: Elicitation, nature, mode of action, and role, p. 69–83, In M. Daniel and R. P. Purkayastha, eds. Handbook of phytoalexin metabolism and action. Marcel Dekker, New York.

Polzin, K. M., Lorenzen, L. L., Olson, T. C., and Shoemaker, R. C. 1994. An unusual polymorphic locus useful for tagging Rps1 resistance alleles in soybean. Theor Appl Genet 89:226–232.

Roslan, H. A., Salter, M. G., Wood, C. D., White, M. R., Croft, K. P., Robson, F., Coupland, G., Doonan, J., Laufs, P., Tomsett, A. B., and Caddick, M. X. 2001. Characterization of the ethanol-inducible alc gene-expression system in *Arabidopsis thaliana*. Plant J. 28:225–235.

Salmeron, J. M., Baker, S. J., Carland, F. M., Mehta, A. Y., and Staskawicz, B. J. 1994. Tomato mutants altered in bacterial disease resistance provide evidence for a new locus controlling pathogen recognition. Plant Cell 6:511–520.

Salmeron, J. M., Oldroyd, G. E. D., Rommens, C. M. T., Scofield, S. R., Kim, H.-S., Lavelle, D. T., Dahlbeck, D., and Staskawicz, B. J. 1996. Tomato Prf is a member of the leucine-rich repeat class of plant disease resistance genes and lies embedded within the Pto kinase gene cluster. Cell 86:123–133.

Schmitt, D. P., and Shannon, J. G. 1992. Differentiating soybean responses to *Heterodera glycines* races. Crop Sci 32:275–277.

Schmitthenner, A. F. 1989. *Phytophthora* rot, p. 35–38, In J. B. Sinclair and P. A. Backman, eds. Compendium of soybean diseases. APS Press, St. Paul, Minn.

Schmitthenner, A. F., Hobe, M., and Bhat, R. G. 1994. *Phytophthora sojae* races in Ohio over a 10-year interval. Plant Disease 78:269–276.

Scofield, S. R., Tobias, C. M., Rathjen, J. P., Chang, J. H., Lavelle, D. T., Michelmore, R. W., and Staskawicz, B. J. 1996. Molecular basis of gene-for-gene specificity in bacterial speck disease of tomato. Science 274:2063–2065.

Sessa, G. and Martin, G. B. 2000. Signal recognition and transduction mediated by the tomato Pto kinase: a paradigm of innate immunity in plants. Microbes Infect 2:1591–1597.

Shigaki, T., and Bhattacharyya, M. K. 1999. Color coding the cell death status of plant suspension cells. Biotechniques 26:1060–2.

Shirasu, K., Lahaye, T., Tan, M.-W., Zhou, F., Azevedo, C., and Schulze-Lefert, P. 1999. A novel class of eukaryotic zinc-binding proteins is required for disease resistance signaling in barley and development in *C. elegans*. Cell 99:355–366.

Song, W.-Y., Wang, G.-L., Kim, H.-S., Pi, L.-Y., Holsten, T., Gardner, J., Wang, B., Zhai, W.-X., Zhu, L.-H., Fauquet, C., and Ronald, P. 1995. A receptor kinase-like protein encoded by the rice disease resistance gene, Xa21. Science 270:1804–1806.

Tang, X., Frederick, R. D., Zhou, J., Halterman, D. A., Jia, Y., and Martin, G. B. 1996. Initiation of plant disease resistance by physical interaction of AvrPto and Pto kinase. Science 274:2060–2063.

Tang, X., Xie, M., Kim, Y. J., Zhou, J., Klessig, D. F., and Martin, G. B. 1999. Overexpression of Pto activates defense responses and confers broad resistance. Plant Cell 11:15–29.

Thomas, C. M., Jones, D. A., Parniske, M., Harrison, K., Balint-Kurti, P. J., Hatzixanthis, K., and Jones, J. D. G. 1997. Characterization of the tomato Cf-4 gene for resistance to *Cladosporium fulvum* identifies sequences that determine recognitional specificity in Cf-4 and Cf-9. Plant Cell 9:2209–2224.

Tyler, B. M., Förster, H., and Coffey, M. D. 1995. Inheritance of avirulence factors and restriction fragment length polymorphism markers in outcrosses of the oomycete *Phytophthora sojae*. Mol Plant Microbe Interact. 8:515–523.

van der Biezen, E. A., Sun, J., Coleman, M. J., Bibb, M. J., and Jones, J. D. 2000. *Arabidopsis* RelA/SpoT homologs implicate (p)ppGpp in plant signaling. Proc Natl Acad Sci USA 97:3747–3752.

Ward, E. W. B. 1990. The interaction of soya beans with *Phytophthora megasperma* f.sp. *glycinea*: Pathogenicity, p. 311–327, In D. Hornby, ed. Biological Control of Soil-Borne Plant Pathogens. C.A.B. International, Wallingford, United Kingdom.

Ward, E. W. B., Cahill, D. M., and Bhattacharyya, M. K. 1989. Early cytological differences between compatible and incompatible interactions of soybeans with *Phytophthora megasperma* f.sp. *glycinea*. Physiol and Mol Plant Pathol 34:267–283.

Ward, E. W. B., Lazarovits, G., Unwin, C. H., and Buzzell, R. I. 1979. Hypocotyl reactions and glyceollin in soybeans inoculated with zoospores of *Phytophthora megasperma* var. *sojae*. Phytopathology 69:951–955.

Warren, R. F., Merritt, P. M., Holub, E., and Innes, R. W. 1999. Identification of three putative signal transduction genes involved in R gene-specified disease resistance in *Arabidopsis*. Genetics 152:401–412.

Warren, R. F., Henk, A., Mowery, P., Holub, E., and Innes, R. W. 1998. A mutation within the leucine-rich repeat domain of the *Arabidopsis* disease resistance gene RPS5 partially suppresses multiple bacterial and down mildew resistance genes. Plant Cell 10:1439–1452.

Whisson, S. C., Drenth, A., Maclean, D. J., and Irwin, J. A. G. 1994. Evidence for outcrossing in *Phytophthora sojae* and linking of a DNA marker to two avirulence genes. Current Genetics 27:77–82.

Whisson, S. C., Drenth, A., Maclean, D. J., and Irwin, J. A. 1995 *Phytophthora sojae* avirulence genes, RAPD, and RFLP markers used to construct a detailed genetic linkage map. Mol Plant Microbe Interact. 8:988–995.

Whitham, S., Dinesh-Kumar, S. P., Choi, D., Hehl, R., Corr, C., and Baker, B. 1994. The product of the tobacco mosaic virus resistance gene N: Similarity to toll and the interleukin-1 receptor. Cell 78:1101–1115.

Williams, J. G. K., Kubelik, A. R., Livak, K. J., Rafalski, J. A., and Tingey, S. V. 1990. DNA polymorphisms amplified by arbitrary primers are useful as genetic markers. Nucleic Acid Research 18:6531–6535.

Wrather, J. A., Anderson, T. R., Arsyad, D. M., Gai, J., Ploper, L. D., Porta-Puglia, A., Ram, H. H., and Yorinori, J. T. 1997. Soybean disease loss estimates for the top 10 soybean producing countries in 1994. Plant Disease 81:107–110.

Yu, Y. G., Buss, G. R., and Maroof, M. A. S. 1996. Isolation of a superfamily of candidate disease-resistance genes in soybean based on a conserved nucleotide-binding site. Proc Natl Acad Sci. USA 93:11751–11756.

Zhang, Y., Fan, W., Kinkema, M., Li, X., Dong, X. 1999. Interaction of NPR1 with basic leucine zipper protein transcription factors that bind sequences required for salicylic acid induction of the PR-1 gene. Proc Natl Acad Sci USA. 96:6523–6528.

Zhang, Z., Xing, A. Staswick, P., Clemente, T. 1999b. The use of glufosinate as a selective agent in *Agrobacterium*-mediated transformation of soybean. Plant Cell Tiss Org Cult 56:37–46.

Zhou, J., Loh, Y.-T., Bressan, R. A., and Martin, G. B. 1995. The tomato gene Pti1 encodes a serine/threonine kinase that is phosphorylated by Pto and is involved in the hypersensitive response. Cell 83:925–935.

Zhou, J. M., Trifa, Y., Silva, H., Pontier, D., Lam, E., Shah, J., Klessig, D. F. 2000. NPR1 differentially interacts with members of the TGA/OBF family of transcription factors that bind an element of the PR-1 gene required for induction by salicylic acid. Mol Plant Microbe Interact 13:191–202.

Example 4

```
Rps1-k-1 (SEQ ID NO:159)
>Rps1-k-1_5'END
TCACTGAATATATTAATAATAAAATTTTTATATAAATAAGATTCAAAGGATAATCACCAACCAAGAAATTTTATGGAAGTAT

TTATCAAATAATTACAATAGATATATAACATAAAAAAAAGAGTTGAATTGAATAATAATTTTTCATGCCATCATTTCAAAAG

AATTACTTTAATCACTCTCTTTATATTATTATTATTATTATTATAACATCTTCACAATATTTTTTATTTTATTAGTATTTATTGA

TTTTATTTAATAAAAAATCACACACTTTTCTTTTTGCACACATCTTTAATCTACATATAAGGATATTCAAATCTTGACTTCAT

TAATATATATTATTGTTTTTAGGGATCAATTAGCATGTGTCTTTTCTTTAATTCTTTCTCTTTTAATTTGTTCAACATCTTTTAT

TGTGTTAATAATTTTTTAATCTCATTTTTTTATTTTCCTCCTAACAAAATTTATTCTATATATAAGAATTAATAAAGATTTAAA

TCTTTTACCACTTGATTAAAAAACATAAATTACTATCAATTATTTTAACTTTTTATAAAATCATGATTCAGATCTTTATACAA

TAACATATCTCATCATGTGTTAGTTGTTTATATCATCACTCTTTAAATCTCTTGAGTCTTTAGTTTAGAGGAGCTAAATTCAA

AATAGAAATATCAAGAAAGTAACATATGTGAGGATCAAAAGTAAAGAGACTCCCAACGTGATAAGTCACCCACCACCATA

ATAATACAAATAATAAAAATAAAAAAGACCATACTTTTGTCTTGCACAGCAGAACGAGTGAAGGTGAAGAGAGTTGACTTA

AGCCAAATCTCATCACATCAGTTCATAGCAACCAATTCCCTTGCCTTTGTCTTTCTACTCTGATCATCTTTTGTTCTTGAGAT

A

>Rps1-k_ORF (SEQ ID NO:1)
ATGGCTGCAGCACTGGTCGGTGGTGCCTTTCTCTCTGCTTTCCTTGATGTGCTTTTCGACAGGCTGGCTTCACCTGACTTTGT

TGACTTGATCCTTGGAAAGAAGCTTAGCAAGAAGTTGCTTCGAAAGTTGGAGACCACTCTCAGAGTGGTTGGAGCTGTGCT

TGATGATGCCGAGAAGAAACAGATCACAAACACCAATGTCAAACACTGGCTCAATGCTCTCAAAGATGCTGTCTATGAAGC

CGATGACTTACTCGACCATGTTTTCACCAAAGCTGCCACCCAAAACAAGGTAAGAAACTTGTTTTCTCGCTTTTCCGATCGG

AAGATCGTTAGTAAGTTGGAGGACATAGTTGTCACCCTAGAGTCTCATTTATTTAAAACTCAAGGAGAGTCTTGATTTGAAAGAG

AGTGCAGTGGAGAACTTGTCATGGAAAGCTCCATCAACATCTCTGGAAGATGGATCTCATATATATGGTAGGGAGAAAGAT

AGGGAGGCCATAATCAAGTTGTTGTCGGAGGATAACAGTGACGGTAGTGAAGTGTCTGTGGTTCCTATTGTGGGCATGGGT

GGGGTTGGAAAAACTACTTTGGCCCAATTGGTGTACAATGATGAGAATTTGAAAGAGAAATTTGATTTTGATTTTAAGGCAT

GGGTTTGTGTTTCTCAAGAATTTGATGTTCTGAAGGTCACAAAAACTATAATACAGGCGGTTACTGGAAATCCTTGTAAATT

GAATGATCTGAATCTACTTCATCTTGAATTGATGGACAAGCTGAAAGATAAAAAATTCCTAATTGTTTTGGATGATGTTTGG

ACAGAGGATTATGTTGATTGGAGTCTTCTTAAGAAACCATTTCAATGTGGGATTATTAGGAGAAGTAAAATTCTTCTAACAA

CCCGCAGTGAAAAGACAGCCTCCGTAGTCCAAACGGTTCAAACCTATCATCTAAACCAATTGTCGAATGAAGATTGTTGGT

CAGTGTTTGCGAACCATGCGTGTCTTTCCTTGGAATCGAACGAGAACACAACACTAGAAAAAATTGGAAAGGAGATTGTTA

AAAGTGCGATGGACTGCCTTTAGCAGCACAGTCCCTTGGAGGCATGTTGAGAAGAAAGCATGACATTGGGGATTGGTATA

ATATTCTGAATAGTGACATTTGGGAACTTTCTGAAAGTGAGTGTAAAGTTATTCCAGCACTGAGACTTAGTTATCATTATCT

CCCTCCACATTTAAAACGGTGCTTTGTTTATTGTTCGTTGTATCCCCAAGATTACGAATTTGATAAAAATGAATTAATCTTGT

TGTGGATGGCTGAAGATCTTTTGAAGAAACCAAGGAAAGGTAGGACTTTAGAAGAGGTTGGTCATGAGTATTTTGATGATTT

GGTTTCGAGATCATTTTTTCCAACGTTCAAGTACAAATAGAAGTAGTTGGCCTTATGGTGAATGTTTTGTGATGCATGACCTC

ATGCATGATCTAGCCAAATCACTCGGTGGAGATTTTTATTTTAGATCAGAAGAACTTGGGAAAGAAACAAAGATCAATACT
```

-continued

```
AAGACTCGTCATTTGTCATTTACCAAATTCAATTCTTCAGTCTTGGACAACTTTGATGTTGTTGGTAGAGCAAAATTTCTGAG

AACTTTCTTGTCCATTATCAATTTTGAAGCTGCTCCATTCAACAACGAGGAGGCACAATGTATCATTGTGTCGAAGCTTATG

TACTTGAGAGTTTTATCATTTTGTGACTTCCAAAGTTTGGATTCTTTGCCTGATTCAATAGGTAAATTGATCCATCTGCGCTA

TTTAGATCTTTCTCATTCAAGTGTAGAAACACTGCCAAAGTCATTGTGTAATTTATACAATCTGCAAACTTTGAAGTTGTGTA

GTTGCAGAAAGCTGACTAAGTTGCCTAGTGACATGTGCAATCTTGTTAACTTGCGTCATCTTGAGATACGTGAAACTCCTAT

AGAAGAGATGCCGAGAGGAATGAGTAAATTAAATCATCTACAACATCTGGATTTCTTTGTTGTGGGCAAGCACAAAGAGAA

TGGGATCAAAGAATTGGGAGGACTTTCAAATCTTCGTGGTCGACTTAAAATTAGGAACTTGGAGAATGTTTCCCAAAGTGA

TGAAGCGTCGGAGGCAAGGATGATGGATAAAAAACACATTAATAGTTTATGGTTGGAATGGTCTAGATGTAATAACAACAG

TACCAACTTCCAACTAGAAATAGATGTGCTTTGCAAGTTACAGCCTCACTTTAACATTGAATCGTTGAGAATAAAAGGCTAT

AAAGGAACCAGATTTCCAGATTGGATGGGAAATTCTTCCTACTGCAATATGATGAGTCTAAAATTGCGTGATTGTGACAACT

GTAGTATGCTTCCTTCACTTGGACAACTACCTTCTCAAGGTCCTTAAGATTGCACGATTGAATAGGCTGAAGACTATTGA

TGCAGGTTTTTACAAGAACGAAGATTGTCGTTCTGGGACGCCCTTTCCCTCCCTTGAATCTCTGGCCATTCATCAAATGCCT

TGTTGGGAGGTGTGGAGTTCCTTCGATTCAGAAGCTTTTCCTGTGCTTGAAATTCTTGAAATACGTGACTGCCCCAAACTAG

AGGGAAGTTTGCCGAATCACCTTCCTGCTCTGAAAACACTTACAATTAGAAATTGTGAGCTGCTTGGCTCTTCTCTCCCAAC

GGCTCCCGCCATTCAAAGTTTGGAGATACGTAAAAGCAATAAAGTAGCACTGCATGCGTTTCCTCTCTTGGTAGAAACTAT

AAAAGTAGAAGGAAGCCCAATGGTGGAGTCCATGATGGAGGCCATCACAAACATCCAACCAACTTGTCTCCGGTCTTTAAC

ATTAAGGGATTGCTCGTCAGCCGTGTCATTTCCGGGTGGTCGTTTACCTGAATCACTGAAGAGTCTGTATATCTCGGATCTT

AAAAAACTGGAATTCCCGACGCAACACAAACATGAGTTACTGGAAACACTGTCAATAGAAAGCAGTTGTGATTCACTCACA

TCTCTTCCATTGGTTACCTTTCCAAATCTCAGAGATCTTGAAATCAGAAACTGTGAAAATATGGAATCTCTTTTGGTATCATT

CTGGAGAGAAGGATTGCCTGCGCCCAACTTGATTACTTTCCAAGTGTGGGGCTCTGACAAGTTGAAGTCGTTGCCTGATGA

GATGAGTACTCTTCTCCCAAAGTTAGAACGTCTCCTCATATCCAACTGCCCAGAAATTGAGTCGTTTCCAAAACGGGGTATG

CCACCTAACCTGAGAATAGTTTGGATTTTCAATTGTGAGAAACTACTGAGCAGCCTAGCATGGCCATCCATGGGCATGCTTA

CTCATCTCTATGTTGGGGGTCGATGTGATGGCATCAAGTCCTTCCCTAAGGAGGGTTTGCTGCCTCCCTCCCTTACGTATCT

GTATCTAAGTGGATTCTCAAATCTGGAGATGTTGGACTGCACGGGGCTTCTCCATCTCACATCCCTGCAACAATTAACCATA

GACGGATGTCCTTTGCTGGAAAATATGGTGGGAGAAAGGCTTCCTGACTCTCTAATAAAATTAACCATAAAGAGTTGTCCTT

TGCTGAAAAAACGATGCCGGAAGAAGCACCCTCAAATTTGGCCTAAAATTTCCCACATCCCTGGCATTAAGGTTGACAATA

GATGGATTTAG
```

>Rps1-k-1_3'END (SEQ ID NO:160)
```
CCACCAAGGAGGACCAACAGGTATCTTCTAAGTCTAACCAACTAGAAAACTAGTTCTGTCAAGGATATGTTTCATTTCATGT

CTTTCTCCTTTTACGTTTTACTAAATCCAATTCATTCTGAAATGGAAATTGACCTTGTATATATGTTACTGAATCTACAGAGA

ATCAACAAATCATCAAAGGCAACGTGGAAATTGACCTTGTATATATGTTTCGAAGAAGTAACGATACAGGTACTAAGTAAC

AACATTGATAAATACTTAAATATAATGATTCTCCGGAAAAATGTTACACATCAGTATTGTTATATTCTAACTTAATTTCTCCT

TAAGATTATTGAGGCCAGAGTGAAAATGACCGTGGGAAACTTATTTTTGTTTTTCAGATATGGTTGATTGGCCCGGAGAAAC

TGTACCTACCCATGAATCTAAGTTCAAATTTGAACTAGTGCTAAATGTAACTTTTAATTTAATTGACGTCAAATTGACACTTT

CTCAATAGCTAAATTTTTATTTGTGAGGTTTTTTGTTAGGTACAATGTGAAGGATGAAAAGGTGTACCAAGTGAACTTTAGA

AGGATTGGATGATTTCAGCTTATCTCTTATCTCCTGTCCTATAAATTAATAGTGGTATGATTATTCTAAAAATATGATAGATA

TGTAGATACGTAAGAATTGATAAAAGCATAATAAATATACAATTGCAATTCGTAAATTGAAGAACATACATACTTCTTAG

ACATTGCTAAAAACAAAATCAAAAAATTGTAGATCATTTTTTCCTATTGTTCACAAATAAGAATGGTACTATCAATGATCAA

TCTCATTTCTTTCTTGAAATTATCTATAAACAAAACAATTTTCATATTTGGTTCATCAAGAAACAATACTTTTTATATTTCTAT

ATTATATTTACTTCTATGTTACATGTCACTATATTTGATTATCATAATTTTTTTTAAAAGAATTGGTCACTTTACATATATGT
```

-continued

```
ACCAGTGAAATATATCAATATATTGGTATCGGATATAGATGCATGAAGCAAATTAAAGTATCAGTACTTTGTAGCAAAACA

CATTCTTCAAATCATGACATGAGGTAAAAAAATATGATGATATTTTTGTAAGTATTGGAAAAAAAAAAAAAAGTAAAGCTT

CTGAAATCAAAGAGACACTAATTTTCCACAACATCCTTCAATTGGGCCCAAGCTTCCTTTCCTATTGACAAATAACTGGTTG

TTAGTGCCAGCTTTTTCTTTTTTCTAGTTTTCCATTGATGGTTAAAAGCTAATATGAACCTGTCACTCCTTAAAATTTCCACC

AAAGTTTGGTAAATAAATATATAGGAGAGTGAATAATGCAAGCCTTGCATTCTATCTCTAAGTTACTAGGTATATGAAACAG

GTATGGGTATGGTTTTAGAAGGTATGTGGTTCATCACTATTTATATTTTTACTACAAGAACCAGGTAAACTTTATTATGGTAC

AGTAAATTTAGTGTGAGGTTGTAACTACGTTATATCCATCTAACTTAGCACGATAATTAAATTTAAAAGCAAAAAGATAAGA

AAAAGGCCAATCTAACAATTGTTACCTCTCTTGCATGAAAAAATCAGAAACAAAAGCCCCACTCTTTCCTCCATGGTGCCT

GTAATTAACAAGCACTTCAAAAATCAATGTTAATTAATTAATTTCCATAAGAAAAAAAAGACAGAAGCTAATGAAATTTAA

GGGGTACAACAAAGATTTGTAGAACGATCATTAATATTAGTGCAACACATCATGATGAAGTGCATGACATAATAATAATGT

GAAACCAATCATGATAAGAACAGAAAATAAATCAGTGCAATTACATGATTAGAAAATAAAGAGGCGATATATCATATTCCT

ATTGATCAGACAATATGACAACGTGTTAAACAAATGTGTCAGGTGCAATAATGAGGGGATAGAGAAGAGAAGGATGATAA

AGAATGTGGTTATGACTTCTACAAAGTCGAATTATTTACTTTTTTAATTTTTTATATTTTCCTTTTCACTTTTCTAATAGTTGT

CCGATTAAGAGGAGTTTATAGAGTAGATTAAATTGGTTTTGAAAAAGAGAAATATCATCTTATACAATTTTTGGTTTTCTTA

ATTCATTGTTCAATTGATGTAGTTTAAAATTTAAATATGATTTAATAAGTTTGGATTGATCTCGA
```

Rps1-k-2
>Rps1-k-2_5'END (SEQ ID NO:161)
```
TTTACATAACTTTTGGATTTAACAAAAAAATTCATTTTCAATTTTACTATTAACTTATTTTTTAAATAAAAATATCCAAAACA

CATGTGCAAACTGCTTCAATACAACTTGTCTCACAGCATCAAAGCACAGGAACATAATTATGCACAGTACCCTTGCAGCCA

TCCACACATATCACCAAGAAAAAAACACACACCACTGCTCCACACGGTTTGGAAAGCGAGAAAGCTGGCCATCACTAACT

TTAATTATAGCATTTTAGAAATATAATCCATTTTTTTAAAATTAACGGTAGAAATATCATCACTCTTTAAATCTCTTGAGTCT

TTAGTTTAGAGGAGCTAAATTTAAAATAGAAATATCAAGAAAGCAACATGTGGGATCAAAAGTAAAGAGACTCCCAACGT

GATAAGTCACCCACCACCAATTCCCTTGCCTTTTGTCTTGCACAGCAGAACGAGTGAAGGTGAAGAGAGTTGACTTAAGCC

AAATCTCATCACATCAGTTCATAGCAACCAATTCCCTTGCCTTTGTCTTTCTACTCTGATCATCTTTTGTTCTTGAGATA
```

>Rps1-k-2 ORF (SEQ ID NO:6)
```
ATGGCAGCAGCACTGGTCGGTGGTGCCTTCCTCTCTGCTTTTCTTGATGTGGTTTTCGACAGGCTGGCTTCACCTGAGTTTGT

TGACTTGATCCGTGGAAAGAAGCTTAGCAAGAAGTTGCTTCAAAAGTTGGAGACCACTCTCAGAGTGGTTGGAGCTGTGCT

TGATGATGCCGAGAAGAAACAGATCACAAACACCAATGTCAAACACTGGCTCAATGATCTCAAACATGCTGTCTATGAAGC

CGATGACTTACTCGACCATGTTTTCACCAAAGCTGCCACCCAAAACAAGGTAAGAGACTTGTTTTCTCGCTTTTCCGATAGG

AAGATCGTTAGTAAGTTGGAGGACATAGTTGTCACACTTGAGTCTCATTTAAAACTCAAGGAGAGTCTTGATTTGAAAGAG

AGTGCAGTGGAGAACTTGTCATGGAAAGCTCCATCAACATCTCTGGAAGATGGATCTCATATATATGGTAGGGAGAAAGAT

AAGGAGGCCATAATCAAGTTGTTGTCGGAGGATAACAGTGACGGTAGAGAAGTGTCTGTGTTTCCTATTGTGGGCATGGGT

GGGGTTGGAAAAACTACTTTGGCCCAATTGGTGTACAACGATGAGAATTTGAAACAGATATTTGATTTTGATTTTAAGGCAT

GGGTTTGTGTTTCTCAAGAATTTGATGTTCTCAAGGTCACAAAAACTATAATAGAGGCGGTGACTGGAAAGGCTTGTAAATT

GAATGATCTGAATCTACTTCATCTTGAATTGATGGACAAGCTGAAAGATAAAAAATTCTTAATTGTTTTGGATGATGTTTGG

ACAGAGGATTATGTTGATTGGCGTCTTCTTAAGAAACCATTTAACCGTGGGATTATTAGGAGAAGTAAAATTCTTCTAACAA

CCCGCAGTGAAAAAACAGCATCTGTAGTCCAAACTGTTCACACCTATCATCTAAACCAATTGTCGAATGAAGATTGTTGGT

CAGTGTTTGCGAACCATGCATGTCTTTCCACGGAATCTAACGAGAACACAGCAACACTAGAAAAAATTGGAAAGGAGATTG

TTAAAAAGTGCAACGGACTGCCTTTAGCAGCAGAGTCGCTTGGAGGCATGTTGAGAAGAAAGCATGACATTGGTGATTGGA

ATAATATTCTCAATAGTGACATTTGGGAACTTTCTGAAAGTGAGTGTAAAGTTATTCCAGCACTGAGACTTAGTTATCATTA

TCTCCCTCCACATTTAAAACGATGCTTTGTTTATTGTTCGTTGTATCCACAAGATTACGAATTTGAAAAAAATGAATTAATCT
```

-continued

```
TGTTGTGGATGGCTGAAGATCTTTTGAAGAAACCAAGGAAAGGTAGGACTTTAGAAGAGGTTGGTCATGAGTATTTTGATG
ATTTGGTTTCGAGATCGTTTTTCCAACGTTCAAGAACAAGTAGTTGGCCTCATCGCAAATGTTTTGTGATGCATGACCTCAT
GCATGATCTAGCCACATCACTCGGTGGAGATTTTTATTTTAGATCAGAAGAACTTGGGGAAAGAAACAAAGATCAATACCAA
GACTCGTCATTTGTCATTTGCCAAATTCAATTCTTCAGTCTTGGACAACTTTGATGTTATTGGTAGAGCAAAATTTCTGAGAA
CCTTCTTGTCCATTATCAATTTTGAAGCTGCTCCATTCAACAATGAGGAGGCACAATGTATCATAATGTCGAAGCTTATGTA
CTTGAGAGTTTTATCATTTTGTGACTTCCAAAGTCTGGATTCTTTGCCTGATTCAATAGGTAAATTGATCCATCTGCGCTATT
TAGATCTCTCTTTTTCAAGAATAGAAACACTGCCAAAGTCATTGTGTAATTTGTACAATCTGCAAACTTTGAAGTTGTGTAG
TTGCAGAAAGCTGACTAAGTTGCCCAGTGACATGCGCAATCTTGTTAACTTGCGTCATCTTGGTATTGCTTATACTCCTATA
AAAGAGATGCCGAGAGGAATGGGTAAATTAAATCATTTACAACATCTGGATTTCTTTGTTGTGGGCAAGCACGAAGAGAAT
GGAATCAAAGAATTGGGAGGACTTTCAAATCTTCGTGGTCAGCTTGAAATTAGGAAGTTGGAGAATGTTTCCCAAAGTGAT
GAAGCGTTGGAGGCAAGGATGATGGATAAAAAACACATTAATAGTTTACAGTTGGAATGGTCTGGATGTAACAACAACAGT
ACCAACTTCCAACTTGAAATAGATGTGCTTTGCAAGTTACAGCCTCACTTTAACATTGAATCGTTGGAAATAAAAGGTTATG
AAGGAACCAGATTTCCAGATTGGATGGGAAATTCTTCCTACTGCAATATGATTAGTCTAAAATTGCGTGATTGTCACAACTG
TAGTATGCTTCCTTCACTTGGACAACTACCTTCTCTCAAGGACCTTGGAATTGCACGATTGAATAGGCTGAAGACTATTGAT
GCAGGTTTCTACAAGAATGAAGAATGTCGTTCTGGGACGTCCTTTCCCTCCCTTGAATCTCTGTCCATTGATGACATGCCTT
GTTGGGAGGTGTGGAGTTCCTTCGATTCAGAAGCTTTTCCTGTGCTTAACAGTCTTGAAATACGTGACTGCCCCAAACTAGA
GGGAAGTTTGCCGAATCACCTTCCTGCTCTGACAAAACTTGTGATTAGAAATTGCGAGCTGCTTGTCTCTTCTCTCCCAACG
GCTCCCGCCATTCAAAGTTTGGAGATATGTAAAAGCAATAAAGTAGCACTGCATGCGTTTCCTCTCTTGGTAGAAACTATAG
AAGTAGAAGGAAGCCCAATGGTGGAGTCCGTGATCGAGGCCATCACTAACATCCAACCAACTTGTCTCCGGTCTTTAACAT
TAAGGGATTGTTCGTCAGCCGTGTCATTTCCGGGTGGTCGTTTACCTGAATCACTGAAGAGTCTGAGTATCAAGGATCTTAA
AAAACTGGAATTCCCGACGCAACACAAACATGAGTTACTGGAAACACTGTCAATAGAAAGCAGTTGTGATTCACTCACATC
TCTTCCATTGGTTACCTTTCCAAATCTCAGATATCTCAGCATCGAAAAGTGTGAAAATATGGAATATCTTTTGGTTTCAGGG
GCAGAGTCATTTAAGAGTCTGTGTTATTTGTTAATTTACAAATGCCCCAACTTTGTATCATTCTGGAGAGAAGGATTGCCTG
CGCCCAACTTGATTACTTTCAGTGTTTGGGGCTCTGACAAGTTGAAGTCGTTGCCTGATGAGATGAGTACTCTTCTCCCAAA
GTTAGAAGATCTCACCATATCCAACTGCCCAGAAATTGAGTCCTTTCCAAAACGGGGTATGCCACCTAACCTGAGAAGAGT
TGAGATTGTCAATTGTGAGAAACTACTGAGCGGCCTAGCATGGCCATCCATGGGCATGCTTACTCATCTCAATGTTGGGGGT
CCATGTGATGGCATCAAGTCCTTCCCTAAAGAGGGTTTGCTGCCTCCCTCCCTTACGTCTCTGTCTCTATATGACTTGTCAAA
TCTGGAGATGTTGGACTGCACGGGCTTCTCCATCTCACATCCCTGCAACAATTACAAATTTTTGGATGTCCAAAGCTGGAG
AATATGGCTGGAGAAAGTCTTCCTTTCTCTCTAATAAAATTAACCATGGTGGAATGTCCTTTGCTGGAAAAACGATGCCGCA
TGAAGCACCCTCAAATTTGGCCTAAAGTTTCCCACATCCCTGGCATTAAGGTTGGCAATAGATGGATTTAG
```

>Rps1-k-2_3'END (SEQ ID NO:162)

```
CCACCAAGGAGGACCAACAGGTATCTTCTAAGTCTAACCAACTAGAAAACTATTTCTGTCAAGGATATGTTTCATTTCATGT
CTTTCTACTTTTACGTTTTACTAAATCCAATTCATTCTGAAATGGAAATTGACCTTGTATATATGTTACTGAATCTACAGAGA
ATCAACAAATCATCAAAGGCAACGTGGAAATTGACCTTGTATATATGTTTCGAAGAAGTAACGATACAGGTACTAAGTAAC
AACATTGACAAATACTTAAATATAATGATTCTCCGGAAAAATGTTACACATCAGTGTTGTTATATTCTAACTTAATTTCTCCT
TAAGATTATTGAGGCCAGAGTGAAAATGACCGTGGGAAACTTATTTTTGTTTTTCAGATATGGTTGATTGGCCCGGAGAAAC
TGTACCTACCCATGAATCTAAGTTCAAATTTGAACTAGTGCTAAATGTAACTTTTAATTTAATTGATGTCAAATTGACACTTT
CTCAATAGCTGAATTTTTATTTGTGAGGTTTTCGTTGGGTACAATGTGAAGGATGAAAAGGTGTACCAAGTGAACTTTAGA
AGGATTGGATGATTTCAGCTTATCTCTTATTCCCTGTCCTATAAATTAATAATGGTATGATTATTCTAAAAATATGATAGATA
TGTAGATAAGTAAGAATTGATAAAAGCATAATAAATATACAATTGCAATTCGGTAAACTGAAGAACATACATACTTCTTAG
```

-continued

```
ACATTGCTAAAAACAAAATCAAAAAATTGTAGATCATTTTTTTCCTATTGTTCACAAATAAGAATGGTACTATCAATGATCA

ATCTCATTTCTTTCTTGAAATTATCTATAAACAAAACAATTTTCATATTGGTTCATCAAGAAACAATACTTTTTATATTTCTA

TATTATACTTACTTCTATGTTACATGTCACTATATTTGATTATCATAATTTTTTTTAAAGAATTGGTCACTTCACATATATGT

ATCAGATATATTGGTATCAGATATAGATGCATGAAGCAAATTAAAGTATCAGTACTTTGTAGCAAAACACATTCTTCAAATC

ATGACATGAGGTAAAAAAAAATAAGATGATATTTTTGTAAGTATTGGAAAAAAAAAGAGTAAAGCTTCTGAAATCAAAGAG

ACACTAATTTTCCACAACATCCTTCAATTGGGCCCAAGCTTCCTTTCCTATGGACAAATAACTGGTTGTTAGTGCCAGCCTT

TTCTTTTTACCAGTTTTCCATTGATGGTTAAAAGCTATTATGAACCTGTCACTCCTTAAAATTTCCACCAAAGTTTGGTAAAT

AAATATATAGGAGAGTGAATAATACAAGTCTTGCATTCTATCTCTAAGTTATTAGGTATATGAAACAGGTATGGGTATTTGG

TTTTAGAAGGTATGTGGTTCATCACTATTTATATTATTACTACAAGAACCAGGTAAACTTTATTATGGTACAGTAAGTTTGGT

GTGAGTTGTAACTACGTTATATCCATCTCACTTAGCACGATAATTAAATTTAAAAGCAAAAAGATAAGAAAAAGGCCAATC

TAACAATTGTTACCTCTCTTGCATGACAAAATCAGAAACAAAAGTCCCACTCTTTCCTCCATGGTGCCTGTAATTAACAAGC

ACTTCAAAAACCAATGTTAATTAATTAATTTCCATAAAAAAAAAAAGGCAAAAGCCAATGAAATTTAACGGGGTACAACAAA

GATTTGTAGAACGATCATTAATATTAGTGCAACGCACCATGATGAAGTGCATGACATAATAATAATGTGGAACCAATCATG

ATAAGAACAGAAAATAAATCAATGCAATTGCATGATCAGAAAATAACGAGGCGATATATCATGTTCCTATTGATAGACAAT

AGGACAACGTGTTAAAGAAATGTGTCAAGTGCAACAATGAGGGAACGGAGAAGAGAAGGATGATAAAGAATGTGGTTATG

ACTTCTACAAAGTCCAATTATTTACTTTTTTAATTTTTTATATTTTCCTTTTCACTTTCCTAATAGTTGTCGGATTAAAAGGAG

TTTATGGAGTAGATTAGATTGGTTTTGAAAAAGAGAAATATCATCTGATACAATTTTTAGTTTTCTTAATTTATTGTTCAATT

GATGTAGTTTAAAAAGTTGCACTAACTGAAGTGGAAAAGGAACATAGGTTGGCATAATGGAAT
```

Rps1-k-3
>Rps1-k-3_5'END (SEQ ID NO:163)
```
ACTTCTCTCTGCAAGCTAAAAAGGAGTGTTGTTTAGGAAACAATTTTGAGGCAGGTGTATTTTGGAAAAAATGAGGAGAGA

GCAAGTGTAGTGGAGTAAAAAAATCCTGTAAGGTTTTGTTTGGTAGTAAAAAGAAAAAAATAATTGTAATGAGAAAAATA

AGTTAGAGGATAAATATCTTCAACACTTAAACAAACAAATAAAAAAGTTTTTCTAGGAAGTTCACTTAAATCTATTTTAACT

ATTGATAAAAATTTATACCTGTTGATTTAAAATAAAATTATATTTATTAAATATGATAGGAGAAAAAATATTTTTTACATATA

GTAAAATATTTTCATTTGCTGAACTTAAATTTTCTTTATCTCTCATTTTACTATTGTTGTTTGAGATGATCTCACTGAATATAT

TAATAATAAAATTTTTATATAAATAAGATTCAAAGGATAATCACCAACCAAGAAATTTTATGGAAGTATTTATCAAATAATT

ACAATAGATATATAACATAAAAAAAAGAGTTGAATTGAATAATAATTTTTCATGCCATCATTTCAAAAGAATTACTTTAATC

ACTCTCTTTATATTATTATTATTATTATTATAACATCTTCACAATATTTTTATTTTATTAGTATTTATTGATTTTATTTAATAA

AAAATCACACACTTTTCTTTTTGCACACATCTTTAATCTACATATAAGGATATTCAAATCTTGACTTCATTAATATATATTAT

TGTTTTTAGGGATCAATTAGCATGTGTCTTTTCTTTAATTCTTTCTCTTTTAATTTGTTCAACATTTTTATTGTGTTAATAATTT

TTTAATCTCATTTTTTTATTTTCCTCCTAACAAAATTTATTCTATATATAAGAATTAATAAAGATTTAAATCTTTTACCACTTG

ATTAAAAAACATAAATTACTATCAATTATTTTAACTTTTTATAAAATCATGATTCAGATCTTTATACAATAACATATCTCATC

ATGTGTTAGTTGTTTATATCATCACTCTTTAAATCTCTTGAGTCTTTAGTTTAGAGGAGCTAAATTCAAAATAGAAATATCAA

GAAAGTAACATATGTGAGGATCAAAAGTAAAGAGACTCCCAACGTGATAAGTCACCCACCACCATAATAATACAAATAAT

AAAAATAAAAAAGACCATACTTTTGTCTTGCACAGCAGAACGAGTGAAGGTGAAGAGAGTTGACTTAAGCCAAATCTCATC

ACATCAGTTCATAGCAACCAATTCCCTTGCCTTTGTCTTTCTACTCTGATCATCTTTTGTTCTTGAGATA
```

>Rps1-k-3_ORF (SEQ ID NO:2)
```
ATGGCTGCAGCACTGGTCGGTGGTGCCTTTCTCTCTGCTTTCCTTGATGTGCTTTTCGACAGGCTGGCTTCACCTGACTTTGT

TGACTTGATCCTTGGAAAGAAGCTTAGCAAGAAGTTGCTTCGAAAGTTGGAGACCACTCTCAGAGTGGTTGGAGCTGTGCT

TGATGATGCCGAGAAGAAACAGATCACAAACACCAATGTCAAACACTGGCTCAATGCTCTCAAAGATGCTGTCTATGAAGC

CGATGACTTACTCGACCATGTTTTCACCAAAGCTGCCACCCAAAACAAGGTAAGAAACTTGTTTTCTCGCTTTTCCGATCGG
```

-continued

```
AAGATCGTTAGTAAGTTGGAGGACATAGTTGTCACCCTAGAGTCTCATTTAAAACTCAAGGAGAGTCTTGATTTGAAAGAG
AGTGCAGTGGAGAACTTGTCATGGAAAGCTCCATCAACATCTCTGGAAGATGGATCTCATATATATGGTAGGGAGAAAGAT
AGGGAGGCCATAATCAAGTTGTTGTCGGAGGATAACAGTGACGGTAGTGAAGTGTCTGTGGTTCCTATTGTGGGCATGGGT
GGGGTTGGAAAAACTACTTTGGCCCAATTGGTGTACAATGATGAGAATTTGAAAGAGAAATTTGATTTTGATTTTAAGGCAT
GGGTTTGTGTTTCTCAAGAATTTGATGTTCTGAAGGTCACAAAAACTATAATACAGGCGGTTACTGGAAATCCTTGTAAATT
GAATGATCTGAATCTACTTCATCTTGAATTGATGGACAAGCTGAAAGATAAAAAATTCCTAATTGTTTTGGATGATGTTTGG
ACAGAGGATTATGTTGATTGGAGTCTTCTTAAGAAACCATTTCAATGTGGGATTATTAGGAGAAGTAAAATTCTTCTAACAA
CCCGCAGTGAAAAGACAGCCTCCGTAGTCCAAACGGTTCAAACCTATCATCTAAACCAATTGTCGAATGAAGATTGTTGGT
CAGTGTTTGCGAACCATGCGTGTCTTTCCTTGGAATCGAACGAGAACACAACACTAGAAAAAATTGGAAAGGAGATTGTTA
AAAAGTGCGATGGACTGCCTTTAGCAGCACAGTCCCTTGGAGGCATGTTGAGAAGAAAGCATGACATTGGGGATTGGTATA
ATATTCTGAATAGTGACATTTGGGAACTTTCTGAAAGTGAGTGTAAAGTTATTCCAGCACTGAGACTTAGTTATCATTATCT
CCCTCCACATTTAAAACGGTGCTTTGTTTATTGTTCGTTGTATCCCCAAGATTACGAATTTGATAAAAATGAATTAATCTTGT
TGTGGATGGCTGAAGATCTTTTGAAGAAACCAAGGAAAGGTAGGACTTTAGAAGAGGTTGGTCATGAGTATTTTGATGATTT
GGTTTCGAGATCATTTTTCCAACGTTCAAGTACAAATAGAAGTAGTTGGCCTTATGGTGAATGTTTTGTGATGCATGACCTC
ATGCATGATCTAGCCAAATCACTCGGTGGAGATTTTTATTTTAGATCAGAAGAACTTGGGAAAGAAACAAAGATCAATACT
AAGACTCGTCATTTGTCATTTACCAAATTCAATTCTTCAGTCTTGGACAACTTTGATGTTGTTGGTAGAGCAAAATTTCTGAG
AACTTTCTTGTCCATTATCAATTTTGAAGCTGCTCCATTCAACAACGAGGAGGCACAATGTATCATTGTGTCGAAGCTTATG
TACTTGAGAGTTTTATCATTTTGTGACTTCCAAAGTTTGGATTCTTTGCCTGATTCAATAGGTAAATTGATCCATCTGCGCTA
TTTAGATCTTTCTCATTCAAGTGTAGAAACACTGCCAAAGTCATTGTGTAATTTATACAATCTGCAAACTTTGAAGTTGTGTA
GTTGCAGAAAGCTGACTAAGTTGCCTAGTGACATGTGCAATCTTGTTAACTTGCGTCATCTTGAGATACGTGAAACTCCTAT
AGAAGAGATGCCGAGAGGAATGAGTAAATTAAATCATCTACAACATCTGGATTTCTTTGTTGTGGGCAAGCACAAAGAGAA
TGGGATCAAAGAATTGGGAGGACTTTCAAATCTTCGTGGTCGACTTAAAATTAGGAACTTGGAGAATGTTTCCCAAAGTGA
TGAAGCGTCGGAGGCAAGGATGATGGATAAAAAACACATTAATAGTTTATGGTTGGAATGGTCTAGATGTAATAACAACAG
TACCAACTTCCAACTAGAAATAGATGTGCTTTGCAAGTTACAGCCTCACTTTAACATTGAATCGTTGAGAATAAAAGGCTAT
AAAGGAACCAGATTTCCAGATTGGATGGGAAATTCTTCCTACTGCAATATGATGAGTCTAAAATTGCGTGATTGTGACAACT
GTAGTATGCTTCCTTCACTTGGACAACTACCTTCTCTCAAGGTCCTTAAGATTGCACGATTGAATAGGCTGAAGACTATTGA
TGCAGGTTTTTACAAGAACGAAGATTGTCGTTCTGGGACGCCCTTTCCCTCCCTTGAATCTCTGGCCATTCATCAAATGCCT
TGTTGGGAGGTGTGGAGTTCCTTCGATTCAGAAGCTTTTCCTGTGCTTGAAATTCTTGAAATACGTGACTGCCCCAAACTAG
AGGGAAGTTTGCCGAATCACCTTCCTGCTCTGAAAACACTTACAATTAGAAATTGTGAGCTGCTTGGCTCTTCTCTCCCAAC
GGCTCCCGCCATTCAAAGTTTGGAGATACGTAAAAGCAATAAAGTAGCACTGCATGCGTTTCCTCTCTTGGTAGAAACTAT
AAAAGTAGAAGGAAGCCCAATGGTGGAGTCCATGATGGAGGCCATCACAAACATCCAACCAACTTGTCTCCGGTCTTTAAC
ATTAAGGGATTGCTCGTCAGCCGTGTCATTTCCGGGTGGTCGTTTACCTGAATCACTGAAGAGTCTGTATATCTCGGATCTT
AAAAAACTGGAATTCCCGACGCAACACAAACATGAGTTACTGGAAACACTGTCAATAGAAAGCAGTTGTGATTCACTCACA
TCTCTTCCATTGGTTACCTTTCCAAATCTCAGAGATCTTGAAATCAGAAACTGTGAAAATATGGAATCTCTTTTGGTATCATT
CTGGAGAGAAGGATTGCCTGCGCCCAACTTGATTACTTTCCAAGTGTGGGCTCTGACAAGTTGAAGTCGTTGCCTGATGA
GATGAGTACTCTTCTCCCAAAGTTAGAACGTCTCCTCATATCCAACTGCCCAGAAATTGAGTCGTTTCCAAAACGGGGTATG
CCACCTAACCTGAGAATAGTTTGGATTTTCAATTGTGAGAAACTACTGAGCAGCCTAGCATGGCCATCCATGGGCATGCTTA
CTCATCTCTATGTTGGGGGTCGATGTGATGGCATCAAGTCCTTCCCTAAGGAGGGTTTGCTGCCTCCCTCCCTTACGTATCT
GTATCTAAGTGGATTCTCAAATCTGGAGATGTTGGACTGCACGGGGCTTCTCCATCTCACATCCCTGCAACAATTAACCATA
GACGGATGTCCTTTGCTGGAAAATATGGTGGGAGAAAGGCTTCCTGACTCTCTAATAAAATTAACCATAAAGAGTTGTCCTT
```

-continued

TGCTGAAAAAACGATGCCGGAAGAAGCACCCTCAAATTTGGCCTAAAATTTCCCACATCCCTGGCATTAAGGTTGACAATA

GATGGATTTAG

>Rps1-k-3_3'END (SEQ ID NO:164)
CCACCAAGGAGGACCAACAGGTATCTTCTAAGTCTAACCAACTAGAAAACTAGTTCTGTCAAGGATATGTTTCATTTCATGT

CTTTCTCCTTTTACGTTTTACTAAATCCAATTCATTCTGAAATGGAAATTGACCTTGTATATATGTTACTGAATCTACAGAGA

ATCAACAAATCATCAAAGGCAACGTGGAAATTGACCTTGTATATATGTTTCGAAGAAGTAACGATACAGGTACTAAGTAAC

AACATTGATAAATACTTAAATATAATGATTCTCCGGAAAAATGTTACACATCAGTATTGTTATATTCTAACTTAATTTCTCCT

TAAGATTATTGAGGCCAGAGTGAAAATGACCGTGGGAAACTTATTTTTGTTTTTCAGATATGGTTGATTGGCCCGGAGAAAC

TGTACCTACCCATGAATCTAAGTTCAAATTTGAACTAGTGCTAAATGTAACTTTTAATTTAATTGATGTCAAATTGACACTTT

CTCAATAGCTGAATTTTTATTTGTGAGGTTTTCGTTGGGTACAATGTGAAGGATGAAAAGGTGTACCAAGTGAACTTTAGA

AGGATTGGATGATTTCAGCTTATCTCTTATTCCCTGTCCTATAAATTAATAATGGTATGATTATTCTAAAAATATGATAGATA

TGTAGATAAGTAAGAATTGATAAAAGCATAATAAATATACAATTGCAATTCGGTAAACTGAAGAACATACATACTTCTTAG

ACATTGCTAAAAACAAAATCAAAAAATTGTAGATCATTTTTTTCCTATTGTTCACAAATAAGAATGGTACTATCAATGATCA

ATCTCATTTCTTTCTTGAAATTATCTATAAACAAAACAATTTTCATATTGGTTCATCAAGAAACAATACTTTTTATATTTCTA

TATTATACTTACTTCTATGTTACATGTCACTATATTTGATTATCATAATTTTTTTTAAAGAATTGGTCACTTCACATATATGT

ATCAGATATATTGGTATCAGATATAGATGCATGAAGCAAATTAAAGTATCAGTACTTTGTAGCAAAACACATTCTTCAAATC

ATGACATGAGGTAAAAAAAAATAAGATGATATTTTGTAAGTATTGGAAAAAAAAAGAGTAAAGCTTCTGAAATCAAAGAG

ACACTAATTTTCCACAACATCCTTCAATTGGGCCCAAGCTTCCTTTCCTATGGACAAATAACTGGTTGTTAGTGCCAGCCTT

TTCTTTTTACCAGTTTTCCATTGATGGTTAAAAGCTATTATGAACCTGTCACTCCTTAAAATTTCCACCAAAGTTTGGTAAAT

AAATATATAGGAGAGTGAATAATACAAGTCTTGCATTCTATCTCTAAGTTATTAGGTATATGAAACAGGTATGGGTATTTGG

TTTTAGAAGGTATGTGGTTCATCACTATTTATATTATTACTACAAGAACCAGGTAAACTTTATTATGGTACAGTAAGTTTGGT

GTGAGTTGTAACTACGTTATATCCATCTCACTTAGCACGATAATTAAATTTAAAAGCAAAAAGATAAGAAAAAGGCCAATC

TAACAATTGTTACCTCTCTTGCATGACAAAATCAGAAACAAAAGTCCCACTCTTTCCTCCATGGTGCCTGTAATTAACAAGC

ACTTCAAAAACCAATGTTAATTAATTAATTTCCATAAAAAAAAAAAGGCAAAAGCCAATGAAATTTAAGGGGTACAACAAA

GATTTGTAGAACGATCATTAATATTAGTGCAACGCACCATGATGAAGTGCATGACATAATAATAATGTGGAACCAATCATG

ATAAGAACAGAAAATAAATCAATGCAATTGCATGATCAGAAAATAACGAGGCGATATATCATGTTCCTATTGATCAGACAA

TAGGACAACGTGTTAAAGAAATGTGTCAAGTGCAACAATGAGGGAACGGAGAAGAGAAGGATGATAAAGAATGTGGTTAT

GACTTCTACAAAGTCCAATTATTTACTTTTTTAATTTTTATATTTTCCTTTTCACTTTCCTAATAGTTGTCGGATTAAAAGGA

GTTTATGGAGTAGATTAGATTGGTTTTGAAAAAGAGAAATATCATCTGATACAATTTTTAGTTTTCTTAATTTATTGTTCAAT

TGATGTAG
Rps1-k-4
>Rps1-k-4_5'END (SEQ ID NO:165)
ACTTCTCTCTGCAAGCTAAAAAGGAGTGTTGTTTAGGAAACAATTTTGAGGCAGGTGTATTTTGAAAAAAATTGAGGAGAG

AGCAAGTGTAGTGGAGTAAAAAAATCCTATAAGATTTTGTTTGATACTAAAAAGAAAAAAATAATTGTGATGAGAAAAAAT

AAGTTAGAGGATAAATATCTTCAACACTTAAACAAACAAATAAAAAAGTTTTTCTAGAAAGTTCACTTAAATCTATTTTCAC

TATTGATAAAAATTTATACCTGTTGATTTAAAATAAAATTATATTTTATAAAAATTATATTTATTAAATATGATAGGAGAAAA

ATATTTTTTACATATAGTAAAATATTTTCATTTGCTGGACTTAAATTTTCTTTATCTCTCATTTTAGTATTGTTGTTTGAGATG

ATCTCACTAAATATATTTTACTTGACTAATAATAAAAATTTATATAGATAAGATTCAAAGGATAATCACCAACCAAAAATT

TTTATGGAAGTATTTATCAAATAATTACAATAGATATATAACATAAAAAAGAGTTGAATTGAATAATAATTTTTCATGCCA

AATTACTTTAATCACTCTATATTATTATTATTATTATCATTATTATAACATCTTCACAATATTCTTTATTTTATTAGTATCTATT

ATTTATTTTATTAATTTTATTTAATAAAAAATCACAAACTTTTCTTTTTGCACACATCTTTAACGTACATATAAAGATATTCA

AATCTTGAATTCATTAATATTATGTTTTTAGGGATCAATTAGCATGTGTCCTTTCTTTAATTCTTTCTCTTTTAATTTGTTCAA

-continued

```
CATTTTTTTTGTCTTAATAATTTTTTAATCTCATTTTTTTATTTTCCTCCTAACAAAATTTATTCTATATATAAGAATTAATAAA

AATTTAAATCTTTTACCACTTGATTAAAAAACATAAATCATTATCAATTATTTTAAATTTATAAAATCATGATTCAGTATTAG

ATCTTTATAAAATACCATATCTCTATGACAATTTTAATGATTAGGTTGAAATATAAACTAACACGAATTTAAGTAAATATTT

CACTATTTACTTTCACATTGAAAAATTGATTTTAAATTTTAACTTTAGAAAAAAAATTCTAAGTTGAGGATCTTTACATAACT

TTTGGATTTAACAAAAAAATTCATTTTCAATTTTACTATTAACTTATTTTTTAAATAAAAATATCCAAAACACATGTGCAAAC

TGCTTCAATACAACTTGTCTCACAGCATCAAAGCACAGGAACATAATTATGCACAGTACCCTTGCAGCCATCCACACATAT

CACCAAGAAAAAAACACACACCACTGCTCCACACGGTTTGGAAAGCGAGAAAGCTGGCCATCACTAACTTTAATTATAGC

ATTTTAGAAATATAATCCATTTTTTTAAAATTAACGGTAGAAATATCATCACTCTTTAAATCTCTTGAGTCTTTAGTTTAGAG

GAGCTAAATTTAAAATAGAAATATCAAGAAAGCAACATGTGGGGATCAAAAGTAAAGAGACTCCCAACGTGATAAGTCAC

CCACCACCAATTCCCTTGCCTTTTGTCTTGCACAGCAGAACGAGTGAAGGTGAAGAGAGTTGACTTAAGCCAAATCTCATC

ACATCAGTTCATAGCAACCAATTCCCTTGCCTTTGTCTTTCTACTCTGATCATCTTTTGTTCTTGAGATA

>Rps1-k-4_ORF (SEQ ID NO:7)
ATGGCAGCAGCACTGGTCGGTGGTGCCTTCCTCTCTGCTTTTCTTGATGTGGTTTTCGACAGGCTGGCTTCACCTGAGTTTGT

TGACTTGATCCGTGGAAAGAAGCTTAGCAAGAAGTTGCTTCAAAAGTTGGAGACCACTCTCAGAGTGGTTGGAGCTGTGCT

TGATGATGCCGAGAAGAAACAGATCACAAACACCAATGTCAAACACTGGCTCAATGATCTCAAACATGCTGTCTATGAAGC

CGATGACTTACTCGACCATGTTTTCACCAAAGCTGCCACCCAAAACAAGGTAAGAGACTTGTTTTCTCGCTTTTCCGATAGG

AAGATCGTTAGTAAGTTGGAGGACATAGTTGTCACACTTGAGTCTCATTTAAAACTCAAGGAGAGTCTTGATTTGAAAGAG

AGTGCAGTGGAGAACTTGTCATGGAAAGCTCCATCAACATCTCTGGAAGATGGATCTCATATATATGGTAGGGAGAAAGAT

AAGGAGGCCATAATCAAGTTGTTGTCGGAGGATAACAGTGACGGTAGAGAAGTGTCTGTGGTTCCTATTGTGGGCATGGGT

GGGGTTGGAAAAACTACTTTGGCCCAATTGGTGTACAACGATGAGAATTTGAAACAGATATTTGATTTTGATTTTAAGGCAT

GGGTTTGTGTTTCTCAAGAATTTGATGTTCTCAAGGTCACAAAAACTATAATAGAGGCGGTGACTGGAAAGGCTTGTAAATT

GAATGATCTGAATCTACTTCATCTTGAATTGATGGACAAGCTGAAAGATAAAAAATTCTTAATTGTTTTGGATGATGTTTGG

ACAGAGGATTATGTTGATTGGCGTCTTCTTAAGAAACCATTTAACCGTGGGATTATTAGGAGAAGTAAAATTCTTCTAACAA

CCCGCAGTGAAAAAACAGCATCTGTAGTCCAAACTGTTCACACCTATCATCTAAACCAATTGTCGAATGAAGATTGTTGGT

CAGTGTTTGCGAACCATGCATGTCTTTCCACGGAATCTAACGAGAACACAGCAACACTAGAAAAAATTGGAAAGGAGATTG

TTAAAAAGTGCAACGGACTGCCTTTAGCAGCAGAGTCGCTTGGAGGCATGTTGAGAAGAAAGCATGACATTGGTGATTGGA

ATAATATTCTCAATAGTGACATTTGGGAACTTTCTGAAAGTGAGTGTAAAGTTATTCCAGCACTGAGACTTAGTTATCATTA

TCTCCCTCCACATTTAAAACGATGCTTTGTTTATTGTTCGTTGTATCCACAAGATTACGAATTTGAAAAAAATGAATTAATCT

TGTTGTGGATGGCTGAAGATCTTTTGAAGAAACCAAGGAAAGGTAGGACTTTAGAAGAGGTTGGTCATGAGTATTTTGATG

ATTTGGTTTCGAGATCGTTTTTCCAACGTTCAAGAACAAGTAGTTGGCCTCATCGCAAATGTTTTGTGATGCATGACCTCAT

GCATGATCTAGCCACATCACTCGGTGGAGATTTTTATTTTAGATCAGAAGAACTTGGGAAAGAAACAAAGATCAATACCAA

GACTCGTCATTTGTCATTTGCCAAATTCAATTCTTCAGTCTTGGACAACTTTGATGTTATTGGTAGAGCAAAATTTCTGAGAA

CCTTCTTGTCCATTATCAATTTTGAAGCTGCTCCATTCAACAATGAGGAGGCACAATGTATCATAATGTCGAAGCTTATGTA

CTTGAGAGTTTTATCATTTTGTGACTTCCAAAGTCTGGATTCTTTGCCTGATTCAATAGGTAAATTGATCCATCTGCGCTATT

TAGATCTCTCTTTTTCAAGAATAGAAACACTGCCAAAGTCATTGTGTAATTTGTACAATCTGCAAACTTTGAAGTTGTGTAG

TTGCAGAAAGCTGACTAAGTTGCCCAGTGACATGCGCAATCTTGTTAACTTGCGTCATCTTGGTATTGCTTATACTCCTATA

AAAGAGATGCCGAGAGGAATGGGTAAATTAAATCATTTACAACATCTGGATTTCTTTGTTGTGGGCAAGCACGAAGAGAAT

GGAATCAAAGAATTGGGAGGACTTTCAAATCTTCGTGGTCAGCTTGAAATTAGGAAGTTGGAGAATGTTTCCCAAAGTGAT

GAAGCGTTGGAGGCAAGGATGATGGATAAAAAACACATTAATAGTTTACAGTTGGAATGGTCTGGATGTAACAACAACAGT

ACCAACTTCCAACTTGAAATAGATGTGCTTTGCAAGTTACAGCCTCACTTTAACATTGAATCGTTGGAAATAAAAGGTTATG
```

-continued

```
AAGGAACCAGATTTCCAGATTGGATGGGAAATTCTTCCTACTGCAATATGATTAGTCTAAAATTGCGTGATTGTCACAACTG
TAGTATGCTTCCTTCACTTGGACAACTACCTTCTCTCAAGGACCTTGGAATTGCACGATTGAATAGGCTGAAGACTATTGAT
GCAGGTTTCTACAAGAATGAAGAATGTCGTTCTGGGACGTCCTTTCCCTCCCTTGAATCTCTGTCCATTGATGACATGCCTT
GTTGGGAGGTGTGGAGTTCCTTCGATTCAGAAGCTTTTCCTGTGCTTAACAGTCTTGAAATACGTGACTGCCCCAAACTAGA
GGGAAGTTTGCCGAATCACCTTCCTGCTCTGACAAAACTTGTGATTAGAAATTGCGAGCTGCTTGTCTCTTCTCTCCCAACG
GCTCCCGCCATTCAAAGTTTGGAGATATGTAAAAGCAATAAAGTAGCACTGCATGCGTTTCCTCTCTTGGTAGAAACTATAG
AAGTAGAAGGAAGCCCAATGGTGGAGTCCGTGATCGAGGCCATCACTAACATCCAACCAACTTGTCTCCGGTCTTTAACAT
TAAGGGATTGTTCGTCAGCCGTGTCATTTCCGGGTGGTCGTTTACCTGAATCACTGAAGAGTCTGAGTATCAAGGATCTTAA
AAAACTGGAATTCCCGACGCAACACAAACATGAGTTACTGGAAACACTGTCAATAGAAAGCAGTTGTGATTCACTCACATC
TCTTCCATTGGTTACCTTTCCAAATCTCAGATATCTCAGCATCGAAAAGTGTGAAAATATGGAATATCTTTTGGTTTCAGGG
GCAGAGTCATTTAAGAGTCTGTGTTATTTGTTAATTTACAAATGCCCCAACTTTGTATCATTCTGGAGAGAAGGATTGCCTG
CGCCCAACTTGATTACTTTCAGTGTTTGGGGCTCTGACAAGTTGAAGTCGTTGCCTGATGAGATGAGTACTCTTCTCCCAAA
GTTAGAAGATCTCACCATATCCAACTGCCCAGAAATTGAGTCCTTTCCAAAACGGGTATGCCACCTAACCTGAGAAGAGT
TGAGATTGTCAATTGTGAGAAACTACTGAGCGGCCTAGCATGGCCATCCATGGGCATGCTTACTCATCTCAATGTTGGGGGT
CCATGTGATGGCATCAAGTCCTTCCCTAAAGAGGGTTTGCTGCCTCCCTCCCTTACGTCTCTGTCTCTATATGACTTGTCAAA
TCTGGAGATGTTGGACTGCACGGGGCTTCTCCATCTCACATCCCTGCAACAATTACAAATTTTTGGATGTCCAAAGCTGGAG
AATATGGCTGGAGAAAGTCTTCCTTTCTCTCTAATAAAATTAACCATGGTGGAATGTCCTTTGCTGGAAAAACGATGCCGCA
TGAAGCACCCTCAAATTTGGCCTAAAGTTTCCCACATCCCTGGCATTAAGGTTGGCAATAGATGGATTTAG
>Rps1-k-4_3'END (SEQ ID NO:166)
CCACCAAGGAGGACCAACAGGTATCTTCTAAGTCTAACCAACTAGAAAACTATTTCTGTCAAGGATATGTTTCATTTCATGT
CTTTCTACTTTTACGTTTTACTAAATCCAATTCATTCTGAAATGGAAATTGACCTTGTATATATGTTACTGAATCTACAGAGA
ATCAACAAATCATCAAAGGCAACGTGGAAATTGACCTTGTATATATGTTTCGAAGAAGTAACGATACAGGTACTAAGTAAC
AACATTGACAAATACTTAAATATAATGATTCTCCGGAAAAATGTTACACATCAGTGTTGTTATATTCTAACTTAATTTCTCCT
TAAGATTATTGAGGCCAGAGTGAAAATGACCGTGGGAAACTTATTTTTGTTTTTCAGATATGGTTGATTGGCCCGGAGAAAC
TGTACCTACCCATGAATCTAAGTTCAAATTTGAACTAGTGCTAAATGTAACTTTTAATTTAATTGATGTCAAATTGACACTTT
CTCAATAGCTGAATTTTTATTTGTGAGGTTTTTCGTTGGGTACAATGTGAAGGATGAAAAGGTGTACCAAGTGAACTTTAGA
AGGATTGGATGATTTCAGCTTATCTCTTATTCCCTGTCCTATAAATTAATAATGGTATGATTATTCTAAAAATATGATAGATA
TGTAGATAAGTAAGAATTGATAAAAGCATAATAAATATACAATTGCAATTCGGTAAACTGAAGAACATACATACTTCTTAG
ACATTGCTAAAAACAAAATCAAAAAATTGTAGATCATTTTTTTCCTATTGTTCACAAATAAGAATGGTACTATCAATGATCA
ATCTCATTTCTTTCTTGAAATTATCTATAAACAAAACAATTTTTCATATTGGTTCATCAAGAAACAATACTTTTTATATTTCTA
TATTATACTTACTTCTATGTTACATGTCACTATATTTGATTATCATAATTTTTTTTTAAAGAATTGGTCACTTCACATATATGT
ATCAGATATATTGGTATCAGATATAGATGCATGAAGCAAATTAAAGTATCAGTACTTTGTAGCAAAACACATTCTTCAAATC
ATGACATGAGGTAAAAAAAAATAAGATGATATTTTTGTAAGTATTGGAAAAAAAAAGAGTAAAGCTTCTGAAATCAAAGAG
ACACTAATTTTCCACAACATCCTTCAATTGGGCCCAAGCTTCCTTTCCTATGGACAAATAACTGGTTGTTAGTGCCAGCCTT
TTCTTTTTACCAGTTTTCCATTGATGGTTAAAAGCTATTATGAACCTGTCACTCCTTAAAATTTCCACCAAAGTTTGGTAAAT
AAATATATAGGAGAGTGAATAATACAAGTCTTGCATTCTATCTCTAAGTTATTAGGTATATGAAACAGGTATGGGTATTTGG
TTTTAGAAGGTATGTGGTTCATCACTATTTATATTATTACTACAAGAACCAGGTAAACTTTATTATGGTACAGTAAGTTTGGT
GTGAGTTGTAACTACGTTATATCCATCTCACTTAGCACGATAATTAAATTTAAAAGCAAAAAGATAAGAAAAAGGCCAATC
TAACAATTGTTACCTCTCTTGCATGACAAAATCAGAAACAAAAGTCCCACTCTTTCCTCCATGGTGCCTGTAATTAACAAGC
ACTTCAAAAACCAATGTTAATTAATTAATTTCCATAAAAAAAAAAAGGCAAAAGCCAATGAAATTTAAGGGGTACAACAAA
```

-continued

```
GATTTGTAGAACGATCATTAATATTAGTGCAACGCACCATGATGAAGTGCATGACATAATAATAATGTGGAACCAATCATG

ATAAGAACAGAAAATAAATCAATGCAATTGCATGATCAGAAAATAACGAGGCGATATATCATGTTCCTATTGATCAGACAA

TAGGACAACGTGTTAAAGAAATGTGTCAAGTGCAACAATGAGGGAACGGAGAAGAGAAGGATGATAAAGAATGTGGTTAT

GACTTCTACAAAGTCCAATTATTTACTTTTTTAATTTTTATATTTTCCTTTTCACTTTCCTAATAGTTGTCGGATTAAAAGGA

GTTTATGGAGTAGATTAGATTGGTTTTGAAAAAGAGAAATATCATCTGATACAATTTTTAGTTTTCTTAATTTATTGTTCAAT

TGATGTAGTTTAAAAAGTTGCACTAACTGAAGTGGAAAAGGAACATAGGTTGGCAT
```

Rps1-k-5
>Rps1-k-5_5'END (SEQ ID NO:167)

```
ACTTCTCTCTGCAAGCTAAAAAGGAGTGTTGTTTAGGAAACAATTTTGAGGCAGGTGTATTTTGGAAAAAATGAGGAGAGA

GCAAGTGTAGTGGAGTAAAAAAATCCTGTAAGGTTTTGTTTGGTAGTAAAAAGAAAAAAATAATTGTAATGAGAAAAAATA

AGTTAGAGGATAAATATCTTCAACACTTAAACAAACAAATAAAAAAGTTTTTCTAGGAAGTTCACTTAAATCTATTTTAACT

ATTGATAAAAATTTATACCTGTTGATTTAAAATAAAATTATATTTATTAAATATGATAGGAGAAAAAATATTTTTTACATATA

GTAAAATATTTTCATTTGCTGAACTTAAATTTTCTTTATCTCTCATTTTACTATTGTTGTTTGAGATGATCTCACTGAATATAT

TAATAATAAAATTTTTATATAAATAAGATTCAAAGGATAATCACCAACCAAGAAATTTTATGGAAGTATTTATCAAATAATT

ACAATAGATATATAACATAAAAAAAGAGTTGAATTGAATAATAATTTTTCATGCCATCATTTCAAAAGAATTACTTTAATC

ACTCTCTTTATATTATTATTATTATTATTATAACATCTTCACAATATTTTTATTTTATTAGTATTTATTGATTTTATTTAATAA

AAAATCACACACTTTTCTTTTTGCACACATCTTTAATCTACATATAAGGATATTCAAATCTTGACTTCATTAATATATATTAT

TGTTTTTAGGGATCAATTAGCATGTGTCTTTTCTTTAATTCTTTCTCTTTTAATTTGTTCAACATTTTTATTGTGTTAATAATTT

TTTAATCTCATTTTTTTATTTTCCTCCTAACAAAATTTATTCTATATATAAGAATTAATAAAGATTTAAATCTTTTACCACTTG

ATTAAAAAACATAAATTACTATCAATTATTTTTAACTTTTTATAAAATCATGATTCAGATCTTTATACAATAACATATCTCATC

ATGTGTTAGTTGTTTATATCATCACTCTTTAAATCTCTTGAGTCTTTAGTTTAGAGGAGCTAAATTCAAAATAGAAATATCAA

GAAAGTAACATATGTGAGGATCAAAAGTAAAGAGACTCCCAACGTGATAAGTCACCCACCACCATAATAATACAAATAAT

AAAAATAAAAAAGACCATACTTTTGTCTTGCACAGCAGAACGAGTGAAGGTGAAGAGAGTTGACTTAAGCCAAATCTCATC

ACATCAG
```

>Rps1-k-5_ORF SEQ ID NO:3
```
ATGGCTGCAGCACTGGTCGGTGGTGCCTTTCTCTCTGCTTTCCTTGATGTGCTTTTCGACAGGCTGGCTTCACCTGACTTTGT

TGACTTGATCCTTGGAAAGAAGCTTAGCAAGAAGTTGCTTCGAAAGTTGGAGACCACTCTCAGAGTGGTTGGAGCTGTGCT

TGATGATGCCGAGAAGAAACAGATCACAAACACCAATGTCAAACACTGGCTAATGCTCTCAAAGATGCTGTCTATGAAGC

CGATGACTTACTCGACCATGTTTTCACCAAAGCTGCCACCCAAAACAAGGTAAGAAACTTGTTTTCTCGCTTTTCCGATCGG

AAGATCGTTAGTAAGTTGGAGGACATAGTTGTCACCCTAGAGTCTCATTTAAAACTCAAGGAGAGTCTTGATTTGAAAGAG

AGTGCAGTGGAGAACTTGTCATGGAAAGCTCCATCAACATCTCTGGAAGATGGATCTCATATATATGGTAGGGAGAAAGAT

AGGGAGGCCATAATCAAGTTGTTGTCGGAGGATAACAGTGACGGTAGTGAAGTGTCTGTGGTTCCTATTGTGGGCATGGGT

GGGGTTGGAAAAACTACTTTGGCCCAATTGGTGTACAATGATGAGAATTTGAAAGAGAAATTTGATTTTGATTTTAAGGCAT

GGGTTTGTGTTTCTCAAGAATTTGATGTTCTGAAGGTCACAAAAACTATAATACAGGCGGTTACTGGAAATCCTTGTAAATT

GAATGATCTGAATCTACTTCATCTTGAATTGATGGACAAGCTGAAAGATAAAAAATTCCTAATTGTTTTGGATGATGTTTGG

ACAGAGGATTATGTTGATTGGAGTCTTCTTAAGAAACCATTTCAATGTGGGATTATTAGGAGAAGTAAAATTCTTCTAACAA

CCCGCAGTGAAAAGACAGCCTCCGTAGTCCAAACGGTTCAAACCTATCATCTAAACCAATTGTCGAATGAAGATTGTTGGT

CAGTGTTTGCGAACCATGCGTGTCTTTCCTTGGAATCGAACGAGAACACAACACTAGAAAAAATTGGAAAGGAGATTGTTA

AAAAGTGCGATGGACTGCCTTTAGCAGCACAGTCCCTTGGAGGCATGTTGAGAAGAAAGCATGACATTGGGGATTGGTATA

ATATTCTGAATAGTGACATTTGGGAACTTTCTGAAAGTGAGTGTAAAGTTATTCCAGCACTGAGACTTAGTTATCATTATCT

CCCTCCACATTTAAAACGGTGCTTTGTTTATTGTTCGTTGTATCCCCAAGATTACGAATTTGATAAAAATGAATTAATCTTGT
```

-continued

```
TGTGGATGGCTGAAGATCTTTTGAAGAAACCAAGGAAAGGTAGGACTTTAGAAGAGGTTGGTCATGAGTATTTTGATGATTT
GGTTTCGAGATCATTTTTCCAACGTTCAAGTACAAATAGAAGTAGTTGGCCTTATGGTGAATGTTTTGTGATGCATGACCTC
ATGCATGATCTAGCCAAATCACTCGGTGGAGATTTTTATTTTAGATCAGAAGAACTTGGGAAAGAAACAAAGATCAATACT
AAGACTCGTCATTTGTCATTTACCAAATTCAATTCTTCAGTCTTGGACAACTTTGATGTTGTTGGTAGAGCAAAATTTCTGAG
AACTTTCTTGTCCATTATCAATTTTGAAGCTGCTCCATTCAACAACGAGGAGGCACAATGTATCATTGTGTCGAAGCTTATG
TACTTGAGAGTTTTATCATTTTGTGACTTCCAAAGTTTGGATTCTTTGCCTGATTCAATAGGTAAATTGATCCATCTGCGCTA
TTTAGATCTTTCTCATTCAAGTGTAGAAACACTGCCAAAGTCATTGTGTAATTTATACAATCTGCAAACTTTGAAGTTGTGTA
GTTGCAGAAAGCTGACTAAGTTGCCTAGTGACATGTGCAATCTTGTTAACTTGCGTCATCTTGAGATACGTGAAACTCCTAT
AGAAGAGATGCCGAGAGGAATGAGTAAATTAAATCATCTACAACATCTGGATTTCTTTGTTGTGGGCAAGCACAAAGAGAA
TGGGATCAAAGAATTGGGAGGACTTTCAAATCTTCGTGGTCGACTTAAAATTAGGAACTTGGAGAATGTTTCCCAAAGTGA
TGAAGCGTCGGAGGCAAGGATGATGGATAAAAAACACATTAATAGTTTATGGTTGGAATGGTCTAGATGTAATAACAACAG
TACCAACTTCCAACTAGAAATAGATGTGCTTTGCAAGTTACAGCCTCACTTTAACATTGAATCGTTGAGAATAAAAGGCTAT
AAAGGAACCAGATTTCCAGATTGGATGGGAAATTCTTCCTACTGCAATATGATGAGTCTAAAATTGCGTGATTGTGACAACT
GTAGTATGCTTCCTTCACTTGGACAACTACCTTCTCTCAAGGTCCTTAAGATTGCACGATTGAATAGGCTGAAGACTATTGA
TGCAGGTTTTTACAAGAACGAAGATTGTCGTTCTGGGACGCCCTTTCCCTCCCTTGAATCTCTGGCCATTCATCAAATGCCT
TGTTGGGAGGTGTGGAGTTCCTTCGATTCAGAAGCTTTTCCTGTGCTTGAAATTCTTGAAATACGTGACTGCCCCAAACTAG
AGGGAAGTTTGCCGAATCACCTTCCTGCTCTGAAAACACTTACAATTAGAAATTGTGAGCTGCTTGGCTCTTCTCTCCCAAC
GGCTCCCGCCATTCAAAGTTTGGAGATACGTAAAAGCAATAAAGTAGCACTGCATGCGTTTCCTCTCTTGGTAGAAACTAT
AAAAGTAGAAGGAAGCCCAATGGTGGAGTCCATGATGGAGGCCATCACAAACATCCAACCAACTTGTCTCCGGTCTTTAAC
ATTAAGGGATTGCTCGTCAGCCGTGTCATTTCCGGGTGGTCGTTTACCTGAATCACTGAAGAGTCTGTATATCTCGGATCTT
AAAAAACTGGAATTCCCGACGCAACACAAACATGAGTTACTGGAAACACTGTCAATAGAAAGCAGTTGTGATTCACTCACA
TCTCTTCCATTGGTTACCTTTCCAAATCTCAGAGATCTTGAAATCAGAAACTGTGAAAATATGGAATCTCTTTTGGTATCATT
CTGGAGAGAAGGATTGCCTGCGCCCAACTTGATTACTTTCCAAGTGTGGGCTCTGACAAGTTGAAGTCGTTGCCTGATGA
GATGAGTACTCTTCTCCCAAAGTTAGAACGTCTCCTCATATCCAACTGCCCAGAAATTGAGTCGTTTCCAAAACGGGGTATG
CCACCTAACCTGAGAATAGTTTGGATTTTCAATTGTGAGAAACTACTGAGCAGCCTAGCATGGCCATCCATGGGCATGCTTA
CTCATCTCTATGTTGGGGGTCGATGTGATGGCATCAAGTCCTTCCCTAAGGAGGGTTTGCTGCCTCCCTCCCTTACGTATCT
GTATCTAAGTGGATTCTCAAATCTGGAGATGTTGGACTGCACGGGCTTCTCCATCTCACATCCCTGCAACAATTAACCATA
GACGGATGTCCTTTGCTGGAAAATATGGTGGGAGAAAGGCTTCCTGACTCTCTAATAAAATTAACCATAAAGAGTTGTCCTT
TGCTGAAAAAACGATGCCGGAAGAAGCACCCTCAAATTTGGCCTAAAATTTCCCACATCCCTGGCATTAAGGTTGACAATA
GATGGATTTAG
```

>Rps1-k-5_3'END (SEQ ID NO:168)
```
CCACCAAGGAGGACCAACAGGTATCTTCTAAGTCTAACCAACTAGAAAACTAGTTCTGTCAAGGATATGTTTCATTTCATGT
CTTTCTCCTTTTACGTTTTACTAAATCCAATTCATTCTGAAATGGAAATTGACCTTGTATATATGTTACTGAATCTACAGAGA
ATCAACAAATCATCAAAGGCAACGTGGAAATTGACCTTGTATATATGTTTCGAAGAAGTAACGATACAGGTACTAAGTAAC
AACATTGATAAATACTTAAATATAATGATTCTCCGGAAAAATGTTACACATCAGTATTGTTATATTCTAACTTAATTTCTCCT
TAAGATTATTGAGGCCAGAGTGAAAATGACCGTGGGAAACTTATTTTTGTTTTTCAGATATGGTTGATTGGCCCGGAGAAAC
TGTACCTACCCATGAATCTAAGTTCAAATTTGAACTAGTGCTAAATGTAACTTTTAATTTAATTGACGTCAAATTGACACTTT
CTCAATAGCTAAATTTTTATTTGTGAGGTTTTTTGTTAGGTACAATGTGAAGGATGAAAAGGTGTACCAAGTGAACTTTAGA
AGGATTGGATGATTTCAGCTTATCTCTTATCTCCTGTCCTATAAATTAATAGTGGTATGATTATTCTAAAAATATGATAGATA
TGTAGATACGTAAGAATTGATAAAAGCATAATAAATATACAATTGCAATTCGGTAAATTGAAGAACATACATACTTCTTAG
```

-continued

```
ACATTGCTAAAAACAAAATCAAAAAATTGTAGATCATTTTTTTCCTATTGTTCACAAATAAGAATGGTACTATCAATGATCAA

TCTCATTTCTTTCTTGAAATTATCTATAAACAAAACAATTTTCATATTTGGTTCATCAAGAAACAATACTTTTTATATTTCTAT

ATTATATTTACTTCTATGTTACATGTCACTATATTTGATTATCATAATTTTTTTTAAAAGAATTGGTCACTTTACATATATGT

ACCAGTGAAATATATCAATATATTGGTATCGGATATAGATGCATGAAGCAAATTAAAGTATCAGTACTTTGTAGCAAAACA

CATTCTTCAAATCATGACATGAGGTAAAAAAATATGATGATATTTTTGTAAGTATTGGAAAAAAAAAAAAAAGTAAAGCTT

CTGAAATCAAAGAGACACTAATTTTCCACAACATCCTTCAATTGGGCCCAAGCTTCCTTTCCTATTGACAAATAACTGGTTG

TTAGTGCCAGCTTTTTCTTTTTTCTAGTTTTCCATTGATGGTTAAAAGCTAATATGAACCTGTCACTCCTTAAAATTTCCACC

AAAGTTTGGTAAATAAATATATAGGAGAGTGAATAATGCAAGCCTTGCATTCTATCTCTAAGTTACTAGGTATATGAAACAG

GTATGGGTATGGTTTTAGAAGGTATGTGGTTCATCACTATTTATATTTTTACTACAAGAACCAGGTAAACTTTATTATGGTAC

AGTAAATTTAGTGTGAGGTTGTAACTACGTTATATCCATCTAACTTAGCACGATAATTAAATTTAAAAGCAAAAAGATAAGA

AAAAGGCCAATCTAACAATTGTTACCTCTCTTGCATGAAAAAATCAGAAACAAAAGCCCCACTCTTTCCTCCATGGTGCCT

GTAATTAACAAGCACTTCAAAAATCAATGTTAATTAATTAATTTCCATAAGAAAAAAAGACAGAAGCTAATGAAATTTAA

GGGGTACAACAAAGATTTGTAGAACGATCATTAATATTAGTGCAACACATCATGATGAAGTGCATGACATAATAATAATGT

GAAACCAATCATGATAAGAACAGAAATAAATCAGTGCAATTACATGATTAGAAAATAAAGAGGCGATATATCATATTCCT

ATTGATCAGACAATATGACAACGTGTTAAACAAATGTGTCAGGTGCAATAATGAGGGGATAGAGAAGAGAAGGATGATAA

AGAATGTGGTTATGACTTCTACAAAGTCGAATTATTTACTTTTTTAATTTTTTATATTTTCCTTTTCACTTTTCTAATAGTTGG

CCGATTAAGAGGAGTTTATAGAGTAGATTAAATTGGTTTTGAAAAAGAGAAATATCATCTTATACAATTTTTGGTTTTCTTA

ATTCATTGTTCAATTGATGTAGTTTAAAATTTAAATATGATTTAATAAGTTTGGATTGATCTCGA
```

Sequence alignment of 5' ends

```
Rpsl-k-2_5end    1 ----------------------------------------------------------------------
Rpsl-k-1_5end    1 ----------------------------------------------------------------------
Rpsl-k-5_5end    1 ACTTCTCTCTGCAAGCTAAAAAGGAGTGTTGTTTAGGAAACAATTTTGAGGCAGGTGTATTTTGSAAAAA
Rpsl-k-3_5end    1 ACTTCTCTCTGCAAGCTAAAAAGGAGTGTTGTTTAGGAAACAATTTTGAGGCAGGTGTATTTTGSAAAAA
Rpsl-k-4_5end    1 ACTTCTCTCTGCAAGCTAAAAAGGAGTGTTGTTTAGGAAACAATTTTGAGGCAGGTGTATTTTGAAAAAA
consensus        1 **********************************************************************

Rpsl-k-2_5end    1 ----------------------------------------------------------------------
Rpsl-k-1_5end    1 ----------------------------------------------------------------------
Rpsl-k-5_5end   71 AT-GAGGAGAGAGCAAGTGTAGTGGAGTAAAAAAATCCTSTAAGSTTTTGTTTGSTAGTAAAAAGAAAAA
Rpsl-k-3_5end   71 AT-GAGGAGAGAGCAAGTGTAGTGGAGTAAAAAAATCCTSTAAGSTTTTGTTTGSTAGTAAAAAGAAAAA
Rpsl-k-4_5end   71 AT-GAGGAGAGAGCAAGTGTAGTGGAGTAAAAAAATCCTATAAGATTTTGTTTGSTACTAAAAAGAAAAA
consensus       71 **********************************************************************

Rpsl-k-2_5end    1 ----------------------------------------------------------------------
Rpsl-k-1_5end    1 ----------------------------------------------------------------------
Rpsl-k-5_5end  140 AATAATTGTSATGAGAAAAAATAAGTTAGAGGATAAATATCTTCAACACTTAAACAAACAAATAAAAAG
Rpsl-k-3_5end  140 AATAATTGTSATGAGAAAAAATAAGTTAGAGGATAAATATCTTCAACACTTAAACAAACAAATAAAAAG
Rpsl-k-4_5end  141 AATAATTGTSATGAGAAAAAATAAGTTAGAGGATAAATATCTTCAACACTTAAACAAACAAATAAAAAG
consensus      141 **********************************************************************

Rpsl-k-2_5end    1 ----------------------------------------------------------------------
Rpsl-k-1_5end    1 ----------------------------------------------------------------------
Rpsl-k-5_5end  210 TTTTTCTAGSAAGTTCACTTAAATCTATTTTAACTATTGATAAAAATTTA--TACCTGTTG-ATTTAA-A
Rpsl-k-3_5end  210 TTTTTCTAGSAAGTTCACTTAAATCTATTTTAACTATTGATAAAAATTTA--TACCTGTTG-ATTTAA-A
Rpsl-k-4_5end  211 TTTTTCTAGSAAGTTCACTTAAATCTATTTTCACTATTGATAAAAATTTA--TACCTGTTG-ATTTAA-A
consensus      211 **********************************************************************

Rpsl-k-2_5end    1 ----------------------------------------------------------------------
Rpsl-k-1_5end    1 ----------------------------------------------------------------------
Rpsl-k-5_5end  276 ATAAAATT-AT-----ATTT---------------ATTAAATATGATAGGAGAAAAATATTTTTTACA
Rpsl-k-3_5end  276 ATAAAATT-AT-----ATTT---------------ATTAAATATGATAGGAGAAAAATATTTTTTACA
Rpsl-k-4_5end  277 ATAAAATT-AT-----ATTTTATAAAAATTATATTTATTAAATATGATAGGAGAAAA-TATTTTTTACA
consensus      281 ******* **    ****               ************* **********

Rpsl-k-2_5end    1 ----------------------------------------------------------------------
Rpsl-k-1_5end    1 ----------------------------------------------------------------------
Rpsl-k-5_5end  324 TATAGTAAAATATTTTCATTTGCTGSACTTAAATTTTCTTTATCTCTCATTTTACTATTGTTGTTTGAGA
Rpsl-k-3_5end  324 TATAGTAAAATATTTTCATTTGCTGSACTTAAATTTTCTTTATCTCTCATTTTACTATTGTTGTTTGAGA
Rpsl-k-4_5end  340 TATAGTAAAATATTTTCATTTGCTGSACTTAAATTTTCTTTATCTCTCATTTTAGTATTGTTGTTTGAGA
consensus      351 ******************************************************  **************
```

```
Rps1-k-2_5end     1 ------------------------------------------------------------
Rps1-k-1_5end     1 ---TCACTGAATATATT-----------AATAATAAAATTTTTATATAAATAAGATTCAAAGGATAATC
Rps1-k-5_5end   394 TGATCTCACTGAATATATT----------AATAATAAAATTTTTATATAAATAAGATTCAAAGGATAATC
Rps1-k-3_5end   394 TGATCTCACTGAATATATT----------AATAATAAAATTTTTATATAAATAAGATTCAAAGGATAATC
Rps1-k-4_5end   410 TGATCTCACTAAATATATTTTACTTGACTAATAATAAAAATTTTATATACATAAGATTCAAAGGATAATC
consensus       421 ****************             *****************************************

Rps1-k-2_5end     1 ------------------------------------------------------------
Rps1-k-1_5end    56 ACCAACCAAGAAATTTATGGAAGTATTTATCAAATAATTACAATAGATATATAACATAAAAAAAAGAGT
Rps1-k-5_5end   454 ACCAACCAAGAAATTTATGGAAGTATTTATCAAATAATTACAATAGATATATAACATAAAAAAAAGAGT
Rps1-k-3_5end   454 ACCAACCAAGAAATTTATGGAAGTATTTATCAAATAATTACAATAGATATATAACATAAAAAAAAGAGT
Rps1-k-4_5end   480 ACCAACCAAAATTTTTATGGAAGTATTTATCAAATAATTACAATAGATATATAACATAAAAAAA-GAGT
consensus       491 *********************************************************************

Rps1-k-2_5end     1 ------------------------------------------------------------
Rps1-k-1_5end   126 TGAATTGAATAATAATTTTTCATGCCATCATTTCAAAAGAATTACTTTAATCACTCTC-TTAT-ATTAT
Rps1-k-5_5end   524 TGAATTGAATAATAATTTTTCATGCCATCATTTCAAAAGAATTACTTTAATCACTCTC-TTAT-ATTAT
Rps1-k-3_5end   524 TGAATTGAATAATAATTTTTCATGCCATCATTTCAAAAGAATTACTTTAATCACTCTC-TTAT-ATTAT
Rps1-k-4_5end   549 TGAATTGAATAATAATTTTTTCATGCC-----------AATTACTTTAATCACTCTATATTAT TATTAT
consensus       561 ******************************                **************** **** *****

Rps1-k-2_5end     1 ------------------------------------------------------------
Rps1-k-1_5end   194 TATTATTATTATTATAACATCTTCACAATATTTTTTATTTTATTAGTAT-----------TTATTGATT
Rps1-k-5_5end   592 TATTATTATTATTATAACATCTTCACAATATTTTTTATTTTATTAGTAT-----------TTATTGATT
Rps1-k-3_5end   592 TATTATTATTATTATAACATCTTCACAATATTTTTTATTTTATTAGTAT-----------TTATTGATT
Rps1-k-4_5end   607 TATTATCATTATTATAACATCTTCACAATATCTTTATTTTATTAGTATCTATTATTTATTTTATTGATT
consensus       631 *******************************  ******************        ********

Rps1-k-2_5end     1 ------------------------------------------------------------
Rps1-k-1_5end   252 TTATTTAATAAAAAATCACACACTTTTCTTTTTGCACACATCTTTAATCTACATATAAGGATATTCAAAT
Rps1-k-5_5end   650 TTATTTAATAAAAAATCACACACTTTTCTTTTTGCACACATCTTTAATCTACATATAAGGATATTCAAAT
Rps1-k-3_5end   650 TTATTTAATAAAAAATCACACACTTTTCTTTTTGCACACATCTTTAATCTACATATAAGGATATTCAAAT
Rps1-k-4_5end   677 TTATTTAATAAAAAATCACAAACTTTTCTTTTTGCACACATCTTTACGTACATATACAGATATTCAAAT
consensus       701 ********************************************************************

Rps1-k-2_5end     1 ------------------------------------------------------------
Rps1-k-1_5end   322 CTTGACTTCATTAATATATATTATTGTTTTTAGGGATCAATTAGCATGTGTCTTTTCTTTAATTCTTTCT
Rps1-k-5_5end   720 CTTGACTTCATTAATATATATTATTGTTTTTAGGGATCAATTAGCATGTGTCTTTTCTTTAATTCTTTCT
Rps1-k-3_5end   720 CTTGACTTCATTAATATATATTATTGTTTTTAGGGATCAATTAGCATGTGTCTTTTCTTTAATTCTTTCT
Rps1-k-4_5end   747 CTTGAATTCATTAATAT-TAT----GTTTTTAGGGATCAATTAGCATGTGTCTTTCTTTAATTCTTTCT
consensus       771 ***************************************************************

Rps1-k-2_5end     1 ------------------------------------------------------------
Rps1-k-1_5end   392 CTTTTAATTTGTTCAACATCTTTTATTGTGTTAATAATTTTTAATCTCATTTTTTATTTTCCTCCTAA
Rps1-k-5_5end   790 CTTTTAATTTGTTCAACAT-TTTTATTGTGTTAATAATTTTTAATCTCATTTTTTATTTTCCTCCTAA
Rps1-k-3_5end   790 CTTTTAATTTGTTCAACAT-TTTTATTGTGTTAATAATTTTTAATCTCATTTTTTATTTTCCTCCTAA
Rps1-k-4_5end   812 CTTTTAATTTGTTCAACAT-TTTTTTTGTCTTAATAATTTTTAATCTCATTTTTTATTTTCCTCCTAA
consensus       841 *****************  *************************************************

Rps1-k-2_5end     1 ------------------------------------------------------------
Rps1-k-1_5end   462 CAAAATTTATTCTATATATAAGAATTAATAAAGATTTAAATCTTTTACCACTTGATTAAAAAACATAAAT
Rps1-k-5_5end   859 CAAAATTTATTCTATATATAAGAATTAATAAAGATTTAAATCTTTTACCACTTGATTAAAAAACATAAAT
Rps1-k-3_5end   859 CAAAATTTATTCTATATATAAGAATTAATAAAGATTTAAATCTTTTACCACTTGATTAAAAAACATAAAT
Rps1-k-4_5end   881 CAAAATTTATTCTATATATAAGAATTAATAAAATTTAAATCTTTTACCACTTGATTAAAAAACATAAAT
consensus       911 *************************************************************************

Rps1-k-2_5end     1 ------------------------------------------------------------
Rps1-k-1_5end   532 TACTATCAATTATTTTAACTTTTTATAAAATCATGATTCAG------ATCTTTATACAATAACATATCTC
Rps1-k-5_5end   929 TACTATCAATTATTTTAACTTTTTATAAAATCATGATTCAG------ATCTTTATACAATAACATATCTC
Rps1-k-3_5end   929 TACTATCAATTATTTTAACTTTTTATAAAATCATGATTCAG------ATCTTTATACAATAACATATCTC
Rps1-k-4_5end   951 CATTATCAATTATTTTAAATTT--ATAAAATCATGATTCAGTATTAGATCTTTATAAAATACCATATCTC
consensus       981 *****************************************           *******************

Rps1-k-2_5end     1 ------------------------------------------------------------
Rps1-k-1_5end   596 ATCATGTGTTAGTTGTTTA-------------------------------------------
Rps1-k-5_5end   993 ATCATGTGTTAGTTGTTTA-------------------------------------------
Rps1-k-3_5end   993 ATCATGTGTTAGTTGTTTA-------------------------------------------
Rps1-k-4_5end  1019 ----TATGACATT--TTAATGATTAGGTTGAAATATAAACTAACACGAATTTAAGTAAATATTTCACTA
consensus      1051 *****************

Rps1-k-2_5end     1 -----------------------------------------------------------TTT
Rps1-k-1_5end   615 ------------------------------------------------------------
Rps1-k-5_5end  1012 ------------------------------------------------------------
Rps1-k-3_5end  1012 ------------------------------------------------------------
Rps1-k-4_5end  1083 TTTACTTTCACATTGAAAAATTGATTTTAAATTTTAACTTTAGAAAAAAAATTCTAAGTTGAGGATCTTT
consensus      1121

Rps1-k-2_5end     4 ACATAACTTTTGGATTTAACAAAAAAATTCATTTTCAATTTTACTATTAACTTATTTTTTAAATAAAAAT
Rps1-k-1_5end   615 ------------------------------------------------------------
Rps1-k-5_5end  1012 ------------------------------------------------------------
Rps1-k-3_5end  1012 ------------------------------------------------------------
Rps1-k-4_5end  1153 ACATAACTTTTGGATTTAACAAAAAAATTCATTTTCAATTTTACTATTAACTTATTTTTTAAATAAAAAT
consensus      1191

Rps1-k-2_5end    74 ATCCAAAACACATGTGCAAACTGCTTCAATACAACTTGTCTCACAGCATCAAAGCACAGGAACATAATTA
Rps1-k-1_5end   615 ------------------------------------------------------------
Rps1-k-5_5end  1012 ------------------------------------------------------------
Rps1-k-3_5end  1012 ------------------------------------------------------------
Rps1-k-4_5end  1223 ATCCAAAACACATGTGCAAACTGCTTCAATACAACTTGTCTCACAGCATCAAAGCACAGGAACATAATTA
consensus      1261

Rps1-k-2_5end   144 TGCACAGTACCCTTGCAGCCATCCACACATATCACCAAGAAAAAAACACACACCACTGCTCCACACGGTT
Rps1-k-1_5end   615 ------------------------------------------------------------
Rps1-k-5_5end  1012 ------------------------------------------------------------
Rps1-k-3_5end  1012 ------------------------------------------------------------
Rps1-k-4_5end  1293 TGCACAGTACCCTTGCAGCCATCCACACATATCACCAAGAAAAAAACACACACCACTGCTCCACACGGTT
consensus      1331
```

-continued

```
Rpsl-k-2_5end   214 TGGAAAGCGAGAAAGCTGGCCATCACTAACTTTAATTATAGCATTTTAGAAATATAATCCATTTTTTTAA
Rpsl-k-1_5end   615 ----------------------------------------------------------------------
Rpsl-k-5_5end  1012 ----------------------------------------------------------------------
Rpsl-k-3_5end  1012 ----------------------------------------------------------------------
Rpsl-k-4_5end  1363 TGGAAAGCGAGAAAGCTGGCCATCACTAACTTTAATTATAGCATTTTAGAAATATAATCCATTTTTTTAA
consensus      1401

Rpsl-k-2_5end   284 AATTAACGGTAGAAATATCATCACTCTTTAAATCTCTTGAGTCTTTAGTTTAGAGGAGCTAAATTTAAAA
Rpsl-k-1_5end   615 ---------------TATCATCACTCTTTAAATCTCTTGAGTCTTTAGTTTAGAGGAGCTAAATTCAAAA
Rpsl-k-5_5end  1012 ---------------TATCATCACTCTTTAAATCTCTTGAGTCTTTAGTTTAGAGGAGCTAAATTCAAAA
Rpsl-k-3_5end  1012 ---------------TATCATCACTCTTTAAATCTCTTGAGTCTTTAGTTTAGAGGAGCTAAATTCAAAA
Rpsl-k-4_5end  1433 AATTAACGGTAGAAATATCATCACTCTTTAAATCTCTTGAGTCTTTAGTTTAGAGGAGCTAAATTTAAAA
consensus      1471 ***************************************************** ****

Rpsl-k-2_5end   354 TAGAAATATCAAGAAACCAACAT--GTGGGGATCAAAAGTAAAGAGACTCCCAACGTGATAAGTCACCCA
Rpsl-k-1_5end   670 TAGAAATATCAAGAAAGTAACATATGTGAGGATCAAAAGTAAAGAGACTCCCAACGTGATAAGTCACCCA
Rpsl-k-5_5end  1067 TAGAAATATCAAGAAAGTAACATATGTGAGGATCAAAAGTAAAGAGACTCCCAACGTGATAAGTCACCCA
Rpsl-k-3_5end  1067 TAGAAATATCAAGAAAGTAACATATGTGAGGATCAAAAGTAAAGAGACTCCCAACGTGATAAGTCACCCA
Rpsl-k-4_5end  1503 TAGAAATATCAAGAAACCAACAT--GTGGGGATCAAAAGTAAAGAGACTCCCAACGTGATAAGTCACCCA
consensus      1541 ****************.*****...***.********************************

Rpsl-k-2_5end   422 CCACCA-----ATTCC--------------------CCTTCCTTTTGTCTTGCACAGCAGAACGAGTGA
Rpsl-k-1_5end   740 CCACCATAATAATACAAATAATAAAAATAAAAAAGACCATAC-TTTTGTCTTGCACAGCAGAACGAGTGA
Rpsl-k-5_5end  1137 CCACCATAATAATACAAATAATAAAAATAAAAAAGACCATAC-TTTTGTCTTGCACAGCAGAACGAGTGA
Rpsl-k-3_5end  1137 CCACCATAATAATACAAATAATAAAAATAAAAAAGACCATAC-TTTTGTCTTGCACAGCAGAACGAGTGA
Rpsl-k-4_5end  1571 CCACCA-----ATTC---------------------CCTTCCTTTTGTCTTGCACAGCAGAACGAGTGA
consensus      1611 ******.....**.*..................**.*********************

Rpsl-k-2_5end   466 AGGTGAAGAGAGTTGACTTAAGCCAAATCTCATCACATCAGTTCATAGCAACCAATTCCCTTGCCTTTGT
Rpsl-k-1_5end   809 AGGTGAAGAGAGTTGACTTAAGCCAAATCTCATCACATCAGTTCATAGCAACCAATTCCCTTGCCTTTGT
Rpsl-k-5_5end  1206 AGGTGAAGAGAGTTGACTTAAGCCAAATCTCATCACATCAGTTCATAGCAACCAATTCCCTTGCCTTTGT
Rpsl-k-3_5end  1206 AGGTGAAGAGAGTTGACTTAAGCCAAATCTCATCACATCAGTTCATAGCAACCAATTCCCTTGCCTTTGT
Rpsl-k-4_5end  1615 AGGTGAAGAGAGTTGACTTAAGCCAAATCTCATCACATCAGTTCATAGCAACCAATTCCCTTGCCTTTGT
consensus      1681 **********************************************************************

Rpsl-k-2_5end   536 CTTTCTACTCTGATCATCTTTTGTTCTTGAGATA
Rpsl-k-1_5end   879 CTTTCTACTCTGATCATCTTTTGTTCTTGAGATA
Rpsl-k-5_5end  1276 CTTTCTACTCTGATCATCTTTTGTTCTTGAGATA
Rpsl-k-3_5end  1276 CTTTCTACTCTGATCATCTTTTGTTCTTGAGATA
Rpsl-k-4_5end  1685 CTTTCTACTCTGATCATCTTTTGTTCTTGAGATA
consensus      1751 **********************************
```

Sequence alignment of ORFs showing the variable nucleic acid residues

```
Rpsl-k-3     1 ATGGCTGCAGCACTGGTCGGTGGTGCCTTTCTCTCTGCTTTCCTTGATGTGCTTTTCGACAGGCTGGCTT
Rpsl-k-1     1 ATGGCTGCAGCACTGGTCGGTGGTGCCTTTCTCTCTGCTTTCCTTGATGTGCTTTTCGACAGGCTGGCTT
Rpsl-k-5     1 ATGGCTGCAGCACTGGTCGGTGGTGCCTTTCTCTCTGCTTTCCTTGATGTGCTTTTCGACAGGCTGGCTT
Rpsl-k-2     1 ATGGCAGCAGCACTGGTCGGTGGTGCCTTCCTCTCTGCTTTTCTTGATGTCGTTTTCGACAGGCTGGCTT
Rpsl-k-4     1 ATGGCAGCAGCACTGGTCGGTGGTGCCTTCCTCTCTGCTTTTCTTGATGTCGTTTTCGACAGGCTGGCTT
consensus    1 *****.***********************.**********.********.*******************

Rpsl-k-3    71 CACCTGACTTTGTTGACTTGATCCTTGGAAAGAAGCTTAGCAAGAAGTTGCTTCGAAAGTTGGAGACCAC
Rpsl-k-1    71 CACCTGACTTTGTTGACTTGATCCTTGGAAAGAAGCTTAGCAAGAAGTTGCTTCGAAAGTTGGAGACCAC
Rpsl-k-5    71 CACCTGACTTTGTTGACTTGATCCTTGGAAAGAAGCTTAGCAAGAAGTTGCTTCGAAAGTTGGAGACCAC
Rpsl-k-2    71 CACCTGAGTTTGTTGACTTGATCCGTGGAAAGAAGCTTAGCAAGAAGTTGCTTGAAAAGTTGGAGACCAC
Rpsl-k-4    71 CACCTGAGTTTGTTGACTTGATCCGTGGAAAGAAGCTTAGCAAGAAGTTGCTTGAAAAGTTGGAGACCAC
consensus   71 *******.****************.****************************.***************

Rpsl-k-3   141 TCTCAGAGTGGTTGGAGCTGTGCTTGATGATGCCGAGAAGAAACAGATCACAAACACCAATGTCAAACAC
Rpsl-k-1   141 TCTCAGAGTGGTTGGAGCTGTGCTTGATGATGCCGAGAAGAAACAGATCACAAACACCAATGTCAAACAC
Rpsl-k-5   141 TCTCAGAGTGGTTGGAGCTGTGCTTGATGATGCCGAGAAGAAACAGATCACAAACACCAATGTCAAACAC
Rpsl-k-2   141 TCTCAGAGTGGTTGGAGCTGTGCTTGATGATGCCGAGAAGAAACAGATCACAAACACCAATGTCAAACAC
Rpsl-k-4   141 TCTCAGAGTGGTTGGAGCTGTGCTTGATGATGCCGAGAAGAAACAGATCACAAACACCAATGTCAAACAC
consensus  141 **********************************************************************

Rpsl-k-3   211 TGGCTCAATGCTCTCAAAGATGCTGTCTATGAAGCCGATGACTTACTCGACCATGTTTTCACCAAAGCTG
Rpsl-k-1   211 TGGCTCAATGCTCTCAAAGATGCTGTCTATGAAGCCGATGACTTACTCGACCATGTTTTCACCAAAGCTG
Rpsl-k-5   211 TGGCTCAATGCTCTCAAAGATGCTGTCTATGAAGCCGATGACTTACTCGACCATGTTTTCACCAAAGCTG
Rpsl-k-2   211 TGGCTCAATGATCTCAAACATGCTGTCTATGAAGCCGATCACTTACTCGACCATGTTTTCACCAAAGCTG
Rpsl-k-4   211 TGGCTCAATGATCTCAAACATGCTGTCTATGAAGCCGATCACTTACTCGACCATGTTTTCACCAAAGCTG
consensus  211 **********.*******.********************.******************************

Rpsl-k-3   281 CCACCCAAAACAAGGTAAGAAACTTGTTTTCTCGCTTTTCCGATCGGAAGATCGTTAGTAAGTTGGAGGA
Rpsl-k-1   281 CCACCCAAAACAAGGTAAGAAACTTGTTTTCTCGCTTTTCCGATCGGAAGATCGTTAGTAAGTTGGAGGA
Rpsl-k-5   281 CCACCCAAAACAAGGTAAGAAACTTGTTTTCTCGCTTTTCCGATCGGAAGATCGTTAGTAAGTTGGAGGA
Rpsl-k-2   281 CCACCCAAAACAAGGTAAGCGACTTGTTTTCTCGCTTTTCCGATAGGAAGATCGTTAGTAAGTTGGAGGA
Rpsl-k-4   281 CCACCCAAAACAAGGTAAGCGACTTGTTTTCTCGCTTTTCCGATAGGAAGATCGTTAGTAAGTTGGAGGA
consensus  281 *******************..*********************.***************************

Rpsl-k-3   351 CATAGTTGTCACCCTAGAGTCTCATTTAAAACTCAAGGAGAGTCTTGATTTGAAAGAGAGTGCAGTGGAG
Rpsl-k-1   351 CATAGTTGTCACCCTAGAGTCTCATTTAAAACTCAAGGAGAGTCTTGATTTGAAAGAGAGTGCAGTGGAG
Rpsl-k-5   351 CATAGTTGTCACCCTAGAGTCTCATTTAAAACTCAAGGAGAGTCTTGATTTGAAAGAGAGTGCAGTGGAG
Rpsl-k-2   351 CATAGTTGTCACACTTGAGTCTCATTTAAAACTCAAGGAGAGTCTTGATTTGAAAGAGAGTGCAGTGGAG
Rpsl-k-4   351 CATAGTTGTCACACTTGAGTCTCATTTAAAACTCAAGGAGAGTCTTGATTTGAAAGAGAGTGCAGTGGAG
consensus  351 ************.**.******************************************************
```

-continued

```
Rpsl-k-3   421 AACTTGTCATGGAAAGCTCCATCAACATCTCTGGAAGATGGATCTCATATATATGGTAGGGAGAAAGATA
Rpsl-k-1   421 AACTTGTCATGGAAAGCTCCATCAACATCTCTGGAAGATGGATCTCATATATATGGTAGGGAGAAAGATA
Rpsl-k-5   421 AACTTGTCATGGAAAGCTCCATCAACATCTCTGGAAGATGGATCTCATATATATGGTAGGGAGAAAGATA
Rpsl-k-2   421 AACTTGTCATGGAAAGCTCCATCAACATCTCTGGAAGATGGATCTCATATATATGGTAGGGAGAAAGATA
Rpsl-k-4   421 AACTTGTCATGGAAAGCTCCATCAACATCTCTGGAAGATGGATCTCATATATATGGTAGGGAGAAAGATA
consensus  421 **********************************************************************

Rpsl-k-3   491 GGGAGGCCATAATCAAGTTGTTGTCGGAGGATAACAGTGACGGTAGTGAAGTGTCTGTGGTTCCTATTGT
Rpsl-k-1   491 GGGAGGCCATAATCAAGTTGTTGTCGGAGGATAACAGTGACGGTAGTGAAGTGTCTGTGGTTCCTATTGT
Rpsl-k-5   491 GGGAGGCCATAATCAAGTTGTTGTCGGAGGATAACAGTGACGGTAGTGAAGTGTCTGTGGTTCCTATTGT
Rpsl-k-2   491 AGGAGGCCATAATCAAGTTGTTGTCGGAGGATAACAGTGACGGTACAGAAGTGTCTGTGGTTCCTATTGT
Rpsl-k-4   491 AGGAGGCCATAATCAAGTTGTTGTCGGAGGATAACAGTGACGGTACAGAAGTGTCTGTGGTTCCTATTGT
consensus  491 .********************************************.***********************

Rpsl-k-3   561 GGGCATGGGTGGGGTTGGAAAAACTACTTTGGCCCAATTGGTGTACAATGATGAGAATTTGAAAGAGAAA
Rpsl-k-1   561 GGGCATGGGTGGGGTTGGAAAAACTACTTTGGCCCAATTGGTGTACAATGATGAGAATTTGAAAGAGAAA
Rpsl-k-5   561 GGGCATGGGTGGGGTTGGAAAAACTACTTTGGCCCAATTGGTGTACAATGATGAGAATTTGAAAGAGAAA
Rpsl-k-2   561 GGGCATGGGTGGGGTTGGAAAAACTACTTTGGCCCAATTGGTGTACAACGATGAGAATTTGAAACAGATA
Rpsl-k-4   561 GGGCATGGGTGGGGTTGGAAAAACTACTTTGGCCCAATTGGTGTACAACGATGAGAATTTGAAACAGATA
consensus  561 ************************************************.***************.***.*

Rpsl-k-3   631 TTTGATTTTGATTTTAAGGCATGGGTTTGTGTTTCTCAAGAATTTGATGTTCTGAAGGTCACAAAAACTA
Rpsl-k-1   631 TTTGATTTTGATTTTAAGGCATGGGTTTGTGTTTCTCAAGAATTTGATGTTCTGAAGGTCACAAAAACTA
Rpsl-k-5   631 TTTGATTTTGATTTTAAGGCATGGGTTTGTGTTTCTCAAGAATTTGATGTTCTGAAGGTCACAAAAACTA
Rpsl-k-2   631 TTTGATTTTGATTTTAAGGCATGGGTTTGTGTTTCTCAAGAATTTGATGTTCTCAAGGTCACAAAAACTA
Rpsl-k-4   631 TTTGATTTTGATTTTAAGGCATGGGTTTGTGTTTCTCAAGAATTTGATGTTCTCAAGGTCACAAAAACTA
consensus  631 *****************************************************.***************

Rpsl-k-3   701 TAATACAGGCGGTTACTGGAAATCCTTGTAAATTGAATGATCTGAATCTACTTCATCTTGAATTGATGGA
Rpsl-k-1   701 TAATACAGGCGGTTACTGGAAATCCTTGTAAATTGAATGATCTGAATCTACTTCATCTTGAATTGATGGA
Rpsl-k-5   701 TAATACAGGCGGTTACTGGAAATCCTTGTAAATTGAATGATCTGAATCTACTTCATCTTGAATTGATGGA
Rpsl-k-2   701 TAATACAGGCGGTGACTGGAAAGGCTTGTAAATTGAATGATCTGAATCTACTTCATCTTGAATTGATGGA
Rpsl-k-4   701 TAATACAGGCGGTGACTGGAAAGGCTTGTAAATTGAATGATCTGAATCTACTTCATCTTGAATTGATGGA
consensus  701 *****.********.*******..**********************************************

Rpsl-k-3   771 CAAGCTGAAAGATAAAAAATTCCTAATTGTTTTGGATGATGTTTGGACAGAGGATTATGTTGATTGGAGT
Rpsl-k-1   771 CAAGCTGAAAGATAAAAAATTCCTAATTGTTTTGGATGATGTTTGGACAGAGGATTATGTTGATTGGAGT
Rpsl-k-5   771 CAAGCTGAAAGATAAAAAATTCCTAATTGTTTTGGATGATGTTTGGACAGAGGATTATGTTGATTGGAGT
Rpsl-k-2   771 CAAGCTGAAAGATAAAAAATTCTTAATTGTTTTGGATGATGTTTGGACAGAGGATTATGTTGATTGGCGT
Rpsl-k-4   771 CAAGCTGAAAGATAAAAAATTCTTAATTGTTTTGGATGATGTTTGGACAGAGGATTATGTTGATTGGCGT
consensus  771 **********************.*********************************************.**

Rpsl-k-3   841 CTTCTTAAGAAACCATTTCAATGTGGGATTATTAGGAGAAGTAAAATTCTTCTAACAACCCGCAGTGAAA
Rpsl-k-1   841 CTTCTTAAGAAACCATTTCAATGTGGGATTATTAGGAGAAGTAAAATTCTTCTAACAACCCGCAGTGAAA
Rpsl-k-5   841 CTTCTTAAGAAACCATTTCAATGTGGGATTATTAGGAGAAGTAAAATTCTTCTAACAACCCGCAGTGAAA
Rpsl-k-2   841 CTTCTTAAGAAACCATTTAACCGTGGGATTATTAGGAGAAGTAAAATTCTTCTAACAACCCGCAGTGAAA
Rpsl-k-4   841 CTTCTTAAGAAACCATTTAACCGTGGGATTATTAGGAGAAGTAAAATTCTTCTAACAACCCGCAGTGAAA
consensus  841 ******************.*..************************************************

Rpsl-k-3   911 AGACAGCCTCCGTAGTCCAAACGGTTCAAACCTATCATCTAAACCAATTGTCGAATGAAGATTGTTGGTC
Rpsl-k-1   911 AGACAGCCTCCGTAGTCCAAACGGTTCAAACCTATCATCTAAACCAATTGTCGAATGAAGATTGTTGGTC
Rpsl-k-5   911 AGACAGCCTCCGTAGTCCAAACGGTTCAAACCTATCATCTAAACCAATTGTCGAATGAAGATTGTTGGTC
Rpsl-k-2   911 AAACAGCATCTGTAGTCCAAACTGTTCACACCTATCATCTAAACCAATTGTCGAATGAAGATTGTTGGTC
Rpsl-k-4   911 AAACAGCATCTGTAGTCCAAACTGTTCACACCTATCATCTAAACCAATTGTCGAATGAAGATTGTTGGTC
consensus  911 *.*****.**.***********.*****.*****************************************

Rpsl-k-3   981 AGTGTTTGCGAACCATGCGTGTCTTTCCTTGGAATCGAACGAGAACACA---ACACTAGAAAAATTGGA
Rpsl-k-1   981 AGTGTTTGCGAACCATGCGTGTCTTTCCTTGGAATCGAACGAGAACACA---ACACTAGAAAAATTGGA
Rpsl-k-5   981 AGTGTTTGCGAACCATGCGTGTCTTTCCTTGGAATCGAACGAGAACACA---ACACTAGAAAAATTGGA
Rpsl-k-2   981 AGTGTTTGCGAACCATGCATGTCTTTCCACGGAATCTAACGAGAACACAGCAACACTAGAAAAATTGGA
Rpsl-k-4   981 AGTGTTTGCGAACCATGCATGTCTTTCCACGGAATCTAACGAGAACACAGCAACACTAGAAAAATTGGA
consensus  981 ******************.********..******.************   ********************

Rpsl-k-3  1048 AAGGAGATTGTTAAAAAGTGCGATGGACTGCCTTTAGCAGCACAGTCCCTTGGAGGCATGTTGAGAAGAA
Rpsl-k-1  1048 AAGGAGATTGTTAAAAAGTGCGATGGACTGCCTTTAGCAGCACAGTCCCTTGGAGGCATGTTGAGAAGAA
Rpsl-k-5  1048 AAGGAGATTGTTAAAAAGTGCGATGGACTGCCTTTAGCAGCACAGTCCCTTGGAGGCATGTTGAGAAGAA
Rpsl-k-2  1051 AAGGAGATTGTTAAAAAGTGCAACGGACTGCCTTTAGCAGCAGAGTCGCTTGGAGGCATGTTGAGAAGAA
Rpsl-k-4  1051 AAGGAGATTGTTAAAAAGTGCAACGGACTGCCTTTAGCAGCAGAGTCGCTTGGAGGCATGTTGAGAAGAA
consensus 1051 *********************.*.*****************.****.**********************

Rpsl-k-3  1118 AGCATGACATTGGGGATTGGTATAATATTCTGAATAGTGACATTTGGGAACTTTCTGAAAGTGAGTGTAA
Rpsl-k-1  1118 AGCATGACATTGGGGATTGGTATAATATTCTGAATAGTGACATTTGGGAACTTTCTGAAAGTGAGTGTAA
Rpsl-k-5  1118 AGCATGACATTGGGGATTGGTATAATATTCTGAATAGTGACATTTGGGAACTTTCTGAAAGTGAGTGTAA
Rpsl-k-2  1121 AGCATGACATTGGTGATTGGAATAATATTCTCAATAGTGACATTTGGGAACTTTCTGAAAGTGAGTGTAA
Rpsl-k-4  1121 AGCATGACATTGGTGATTGGAATAATATTCTCAATAGTGACATTTGGGAACTTTCTGAAAGTGAGTGTAA
consensus 1121 *************.******.**********.**************************************

Rpsl-k-3  1188 AGTTATTCCAGCACTGAGACTTAGTTATCATTATCTCCCTCCACATTTAAAACGGTGCTTTGTTTATTGT
Rpsl-k-1  1188 AGTTATTCCAGCACTGAGACTTAGTTATCATTATCTCCCTCCACATTTAAAACGGTGCTTTGTTTATTGT
Rpsl-k-5  1188 AGTTATTCCAGCACTGAGACTTAGTTATCATTATCTCCCTCCACATTTAAAACGGTGCTTTGTTTATTGT
Rpsl-k-2  1191 AGTTATTCCAGCACTGAGACTTAGTTATCATTATCTCCCTCCACATTTAAAACGATGCTTTGTTTATTGT
Rpsl-k-4  1191 AGTTATTCCAGCACTGAGACTTAGTTATCATTATCTCCCTCCACATTTAAAACGATGCTTTGTTTATTGT
consensus 1191 ******************************************************.***************

Rpsl-k-3  1258 TCGTTGTATCCCCAAGATTACGAATTTGATAAAAATGAATTAATCTTGTTGTGGATGGCTGAAGATCTTT
Rpsl-k-1  1258 TCGTTGTATCCCCAAGATTACGAATTTGATAAAAATGAATTAATCTTGTTGTGGATGGCTGAAGATCTTT
Rpsl-k-5  1258 TCGTTGTATCCCCAAGATTACGAATTTGATAAAAATGAATTAATCTTGTTGTGGATGGCTGAAGATCTTT
Rpsl-k-2  1261 TCGTTGTATCCACAAGATTACGAATTTGAAAAAAATGAATTAATCTTGTTGTGGATGGCTGAAGATCTTT
Rpsl-k-4  1261 TCGTTGTATCCACAAGATTACGAATTTGAAAAAAATGAATTAATCTTGTTGTGGATGGCTGAAGATCTTT
consensus 1261 ***********.*****************.****************************************
```

-continued

```
Rps1-k-3   1328 TGAAGAAACCAAGGAAAGGTAGGACTTTAGAAGAGGTTGGTCATGAGTATTTTGATGATTTGGTTTCGAG
Rps1-k-1   1328 TGAAGAAACCAAGGAAAGGTAGGACTTTAGAAGAGGTTGGTCATGAGTATTTTGATGATTTGGTTTCGAG
Rps1-k-5   1328 TGAAGAAACCAAGGAAAGGTAGGACTTTAGAAGAGGTTGGTCATGAGTATTTTGATGATTTGGTTTCGAG
Rps1-k-2   1331 TGAAGAAACCAAGGAAAGGTAGGACTTTAGAAGAGGTTGGTCATGAGTATTTTGATGATTTGGTTTCGAG
Rps1-k-4   1331 TGAAGAAACCAAGGAAAGGTAGGACTTTAGAAGAGGTTGGTCATGAGTATTTTGATGATTTGGTTTCGAG
consensus  1331 *********************************************************************

Rps1-k-3   1398 ATCATTTTTCCAACGTTCAAGTACAAATAGAAGTAGTTGGCCTTATGGTGAATGTTTTGTGATGCATGAC
Rps1-k-1   1398 ATCATTTTTCCAACGTTCAAGTACAAATAGAAGTAGTTGGCCTTATGGTGAATGTTTTGTGATGCATGAC
Rps1-k-5   1398 ATCATTTTTCCAACGTTCAAGTACAAATAGAAGTAGTTGGCCTTATGGTGAATGTTTTGTGATGCATGAC
Rps1-k-2   1401 ATCGTTTTTCCAACGTTCAAGAACAA------GTAGTTGGCCTCATCGCAAATGTTTTGTGATGCATGAC
Rps1-k-4   1401 ATCGTTTTTCCAACGTTCAAGAACAA------GTAGTTGGCCTCATCGCAAATGTTTTGTGATGCATGAC
consensus  1401 ***.*****************.****......***********.**.*.********************

Rps1-k-3   1468 CTCATGCATGATCTAGCCAAATCACTCGGTGGAGATTTTTATTTTAGATCAGAAGAACTTGGGAAAGAAA
Rps1-k-1   1468 CTCATGCATGATCTAGCCAAATCACTCGGTGGAGATTTTTATTTTAGATCAGAAGAACTTGGGAAAGAAA
Rps1-k-5   1468 CTCATGCATGATCTAGCCAAATCACTCGGTGGAGATTTTTATTTTAGATCAGAAGAACTTGGGAAAGAAA
Rps1-k-2   1465 CTCATGCATGATCTAGCCACATCACTCGGTGGAGATTTTTATTTTAGATCAGAAGAACTTGGGAAAGAAA
Rps1-k-4   1465 CTCATGCATGATCTAGCCACATCACTCGGTGGAGATTTTTATTTTAGATCAGAAGAACTTGGGAAAGAAA
consensus  1471 *******************.**************************************************

Rps1-k-3   1538 CAAAGATCAATACTAAGACTCGTCATTTGTCATTTACCAAATTCAATTCTTCAGTCTTGGACAACTTTGA
Rps1-k-1   1538 CAAAGATCAATACTAAGACTCGTCATTTGTCATTTACCAAATTCAATTCTTCAGTCTTGGACAACTTTGA
Rps1-k-5   1538 CAAAGATCAATACTAAGACTCGTCATTTGTCATTTACCAAATTCAATTCTTCAGTCTTGGACAACTTTGA
Rps1-k-2   1535 CAAAGATCAATACCAAGACTCGTCATTTGTCATTTCCAAATTCAATTCTTCAGTCTTGGACAACTTTGA
Rps1-k-4   1535 CAAAGATCAATACCAAGACTCGTCATTTGTCATTTCCAAATTCAATTCTTCAGTCTTGGACAACTTTGA
consensus  1541 *************.*******************..**********************************

Rps1-k-3   1608 TGTTGTTGGTAGAGCAAAATTTCTGAGAACTTTCTTGTCCATTATCAATTTTGAAGCTGCTCCATTCAAC
Rps1-k-1   1608 TGTTGTTGGTAGAGCAAAATTTCTGAGAACTTTCTTGTCCATTATCAATTTTGAAGCTGCTCCATTCAAC
Rps1-k-5   1608 TGTTGTTGGTAGAGCAAAATTTCTGAGAACTTTCTTGTCCATTATCAATTTTGAAGCTGCTCCATTCAAC
Rps1-k-2   1605 TGTTATTGGTAGAGCAAAATTTCTGAGAACCTTCTTGTCCATTATCAATTTTGAAGCTGCTCCATTCAAC
Rps1-k-4   1605 TGTTATTGGTAGAGCAAAATTTCTGAGAACCTTCTTGTCCATTATCAATTTTGAAGCTGCTCCATTCAAC
consensus  1611 ****.*************************.**************************************

Rps1-k-3   1678 AACGAGGAGGCACAATGTATCATTGTGTCGAAGCTTATGTACTTGAGAGTTTTATCATTTTGTGACTTCC
Rps1-k-1   1678 AACGAGGAGGCACAATGTATCATTGTGTCGAAGCTTATGTACTTGAGAGTTTTATCATTTTGTGACTTCC
Rps1-k-5   1678 AACGAGGAGGCACAATGTATCATTGTGTCGAAGCTTATGTACTTGAGAGTTTTATCATTTTGTGACTTCC
Rps1-k-2   1675 AATGAGGAGGCACAATGTATCATAATGTCGAAGCTTATGTACTTGAGAGTTTTATCATTTTGTGACTTCC
Rps1-k-4   1675 AATGAGGAGGCACAATGTATCATAATGTCGAAGCTTATGTACTTGAGAGTTTTATCATTTTGTGACTTCC
consensus  1681 **.********************..*********************************************

Rps1-k-3   1748 AAAGTTTGGATTCTTTGCCTGATTCAATAGGTAAATTGATCCATCTGCGCTATTTAGATCTTTCTCATTC
Rps1-k-1   1748 AAAGTTTGGATTCTTTGCCTGATTCAATAGGTAAATTGATCCATCTGCGCTATTTAGATCTTTCTCATTC
Rps1-k-5   1748 AAAGTTTGGATTCTTTGCCTGATTCAATAGGTAAATTGATCCATCTGCGCTATTTAGATCTTTCTCATTC
Rps1-k-2   1745 AAAGTCTGGATTCTTTGCCTGATTCAATAGGTAAATTGATCCATCTGCGCTATTTAGATCTCTCTTTTTC
Rps1-k-4   1745 AAAGTCTGGATTCTTTGCCTGATTCAATAGGTAAATTGATCCATCTGCGCTATTTAGATCTCTCTTTTTC
consensus  1751 *****.******************************************************..***...**

Rps1-k-3   1818 AAGTGTAGAAACACTGCCAAAGTCATTGTGTAATTTATACAATCTGCAAACTTTGAAGTTGTGTAGTTGC
Rps1-k-1   1818 AAGTGTAGAAACACTGCCAAAGTCATTGTGTAATTTATACAATCTGCAAACTTTGAAGTTGTGTAGTTGC
Rps1-k-5   1818 AAGTGTAGAAACACTGCCAAAGTCATTGTGTAATTTATACAATCTGCAAACTTTGAAGTTGTGTAGTTGC
Rps1-k-2   1815 AACAATAGAAACACTGCCAAAGTCATTGTGTAATTTGTACAATCTGCAAACTTTGAAGTTGTGTAGTTGC
Rps1-k-4   1815 AACAATAGAAACACTGCCAAAGTCATTGTGTAATTTGTACAATCTGCAAACTTTGAAGTTGTGTAGTTGC
consensus  1821 **...****************************.**********************************

Rps1-k-3   1888 AGAAAGCTGACTAAGTTGCCTAGTGACATGTGCAATCTTGTTAACTTGCGTCATCTTGAGATACGTGAAA
Rps1-k-1   1888 AGAAAGCTGACTAAGTTGCCTAGTGACATGTGCAATCTTGTTAACTTGCGTCATCTTGAGATACGTGAAA
Rps1-k-5   1888 AGAAAGCTGACTAAGTTGCCTAGTGACATGTGCAATCTTGTTAACTTGCGTCATCTTGAGATACGTGAAA
Rps1-k-2   1885 AGAAAGCTGACTAAGTTGCCCAGTGACATCCGCAATCTTGTTAACTTGCGTCATCTTGGTATTGCTTATA
Rps1-k-4   1885 AGAAAGCTGACTAAGTTGCCCAGTGACATCCGCAATCTTGTTAACTTGCGTCATCTTGGTATTGCTTATA
consensus  1891 ********************.********..*************************...**....*.*

Rps1-k-3   1958 CTCCTATAGAAGAGATGCCGAGAGGAATGAGTAAATTAAATCATCTACAACATCTGGATTTCTTTGTTGT
Rps1-k-1   1958 CTCCTATAGAAGAGATGCCGAGAGGAATGAGTAAATTAAATCATCTACAACATCTGGATTTCTTTGTTGT
Rps1-k-5   1958 CTCCTATAGAAGAGATGCCGAGAGGAATGAGTAAATTAAATCATCTACAACATCTGGATTTCTTTGTTGT
Rps1-k-2   1955 CTCCTATAAAAGAGATGCCGAGAGGAATGCGTAAATTAAATCATTTACAACATCTGGATTTCTTTGTTGT
Rps1-k-4   1955 CTCCTATAAAAGAGATGCCGAGAGGAATGCGTAAATTAAATCATTTACAACATCTGGATTTCTTTGTTGT
consensus  1961 ********.********************.**************.************************

Rps1-k-3   2028 GGGCAAGCACAAAGAGAATGGGATCAAAGAATTGGGAGGACTTTCAAATCTTCGTGGTCGACTTAAAATT
Rps1-k-1   2028 GGGCAAGCACAAAGAGAATGGGATCAAAGAATTGGGAGGACTTTCAAATCTTCGTGGTCGACTTAAAATT
Rps1-k-5   2028 GGGCAAGCACAAAGAGAATGGGATCAAAGAATTGGGAGGACTTTCAAATCTTCGTGGTCGACTTAAAATT
Rps1-k-2   2025 GGGCAAGCACCAAGAGAATGGAATCAAAGAATTGGGAGGACTTTCAAATCTTCGTGGTCACCTTGAAATT
Rps1-k-4   2025 GGGCAAGCACCAAGAGAATGAATCAAAGAATTGGGAGGACTTTCAAATCTTCGTGGTCACCTTGAAATT
consensus  2031 **********.*********..**********************************...***.*****

Rps1-k-3   2098 AGGAACTTGGAGAATGTTTCCCAAAGTGATGAAGCGTCGGAGGCAAGGATGATGGATAAAAAACACATTA
Rps1-k-1   2098 AGGAACTTGGAGAATGTTTCCCAAAGTGATGAAGCGTCGGAGGCAAGGATGATGGATAAAAAACACATTA
Rps1-k-5   2098 AGGAACTTGGAGAATGTTTCCCAAAGTGATGAAGCGTCGGAGGCAAGGATGATGGATAAAAAACACATTA
Rps1-k-2   2095 AGGAAGTTGGAGAATGTTTCCCAAAGTGATGAAGCGTTGGAGGCAAGGATGATGGATAAAAAACACATTA
Rps1-k-4   2095 AGGAAGTTGGAGAATGTTTCCCAAAGTGATGAAGCGTTGGAGGCAAGGATGATGGATAAAAAACACATTA
consensus  2101 *****.*******************************.********************************

Rps1-k-3   2168 ATAGTTTATGGTTGGAATGGTCTAGATGTAATAACAACAGTACCAACTTCCAACTAGAAATAGATGTGCT
Rps1-k-1   2168 ATAGTTTATGGTTGGAATGGTCTAGATGTAATAACAACAGTACCAACTTCCAACTAGAAATAGATGTGCT
Rps1-k-5   2168 ATAGTTTATGGTTGGAATGGTCTAGATGTAATAACAACAGTACCAACTTCCAACTAGAAATAGATGTGCT
Rps1-k-2   2165 ATAGTTTACAGTTGGAATGGTCTCGATGTAACAACAACAGTACCAACTTCCAACTTGAAATAGATGTGCT
Rps1-k-4   2165 ATAGTTTACAGTTGGAATGGTCTCGATGTAACAACAACAGTACCAACTTCCAACTTGAAATAGATGTGCT
consensus  2171 ********..*************.*******.**********************.**************
```

```
                -continued
Rpsl-k-3 2238 TTGCAAGTTACAGCCTCACTTTAACATTGAATCGTTGAGAATAAAAGGCTATAAAGGAACCAGATTTCCA
Rpsl-k-1 2238 TTGCAAGTTACAGCCTCACTTTAACATTGAATCGTTGAGAATAAAAGGCTATAAAGGAACCAGATTTCCA
Rpsl-k-5 2238 TTGCAAGTTACAGCCTCACTTTAACATTGAATCGTTGAGAATAAAAGGCTATAAAGGAACCAGATTTCCA
Rpsl-k-2 2235 TTGCAAGTTACAGCCTCACTTTAACATTGAATCGTTCCAAATAAAAGGTTATCAAGGAACCAGATTTCCA
Rpsl-k-4 2235 TTGCAAGTTACAGCCTCACTTTAACATTGAATCGTTCCAAATAAAAGGTTATCAAGGAACCAGATTTCCA
consensus 2241 ************************************..********.***.**************

Rpsl-k-3 2308 GATTGGATGGGAAATTCTTCCTACTGCAATATGATGAGTCTAAAATTGCGTGATTGTGACAACTGTAGTA
Rpsl-k-1 2308 GATTGGATGGGAAATTCTTCCTACTGCAATATGATGAGTCTAAAATTGCGTGATTGTGACAACTGTAGTA
Rpsl-k-5 2308 GATTGGATGGGAAATTCTTCCTACTGCAATATGATGAGTCTAAAATTGCGTGATTGTGACAACTGTAGTA
Rpsl-k-2 2305 GATTGGATGGGAAATTCTTCCTACTGCAATATGATTAGTCTAAAATTGCGTGATTGTCACAACTGTAGTA
Rpsl-k-4 2305 GATTGGATGGGAAATTCTTCCTACTGCAATATGATTAGTCTAAAATTGCGTGATTGTCACAACTGTAGTA
consensus 2311 ***********************************.**********************.**********

Rpsl-k-3 2378 TGCTTCCTTCACTTGGACAACTACCTTCTCTCAAGGTCCTTAAGATTGCACGATTGAATAGGCTGAAGAC
Rpsl-k-1 2378 TGCTTCCTTCACTTGGACAACTACCTTCTCTCAAGGTCCTTAAGATTGCACGATTGAATAGGCTGAAGAC
Rpsl-k-5 2378 TGCTTCCTTCACTTGGACAACTACCTTCTCTCAAGGTCCTTAAGATTGCACGATTGAATAGGCTGAAGAC
Rpsl-k-2 2375 TGCTTCCTTCACTTGGACAACTACCTTCTCTCAAGCACCTTGGAATTGCACGATTGAATAGGCTGAAGAC
Rpsl-k-4 2375 TGCTTCCTTCACTTGGACAACTACCTTCTCTCAAGCACCTTGGAATTGCACGATTGAATAGGCTGAAGAC
consensus 2381 ***********************************.****....*************************

Rpsl-k-3 2448 TATTGATGCAGGTTTTTACAAGAACGAAGATTGTCGTTCTGGGACGCCCTTTCCCTCCCTTGAATCTCTG
Rpsl-k-1 2448 TATTGATGCAGGTTTTTACAAGAACGAAGATTGTCGTTCTGGGACGCCCTTTCCCTCCCTTGAATCTCTG
Rpsl-k-5 2448 TATTGATGCAGGTTTTTACAAGAACGAAGATTGTCGTTCTGGGACGCCCTTTCCCTCCCTTGAATCTCTG
Rpsl-k-2 2445 TATTGATGCAGGTTTCTACAAGAATGAAGAATGTCGTTCTGGGACGTCCTTTCCCTCCCTTGAATCTCTG
Rpsl-k-4 2445 TATTGATGCAGGTTTCTACAAGAATGAAGAATGTCGTTCTGGGACGTCCTTTCCCTCCCTTGAATCTCTG
consensus 2451 ***************.********.*****.***************.**********************

Rpsl-k-3 2518 GCCATTCATCAAATGCCTTGTTGGGAGGTGTGGAGTTCCTTCGATTCAGAAGCTTTTCCTGTGCTTGAAA
Rpsl-k-1 2518 GCCATTCATCAAATGCCTTGTTGGGAGGTGTGGAGTTCCTTCGATTCAGAAGCTTTTCCTGTGCTTGAAA
Rpsl-k-5 2518 GCCATTCATCAAATGCCTTGTTGGGAGGTGTGGAGTTCCTTCGATTCAGAAGCTTTTCCTGTGCTTGAAA
Rpsl-k-2 2515 TCCATTGATGACATGCCTTGTTGGGAGGTGTGGAGTTCCTTCGATTCAGAAGCTTTTCCTGTGCTTAACA
Rpsl-k-4 2515 TCCATTGATGACATGCCTTGTTGGGAGGTGTGGAGTTCCTTCGATTCAGAAGCTTTTCCTGTGCTTAACA
consensus 2521 .*****.**.*.*********************************************************.*.*

Rpsl-k-3 2588 TTCTTGAAATACGTGACTGCCCCAAACTAGAGGGAAGTTTGCCGAATCACCTTCCTGCTCTGAAAACACT
Rpsl-k-1 2588 TTCTTGAAATACGTGACTGCCCCAAACTAGAGGGAAGTTTGCCGAATCACCTTCCTGCTCTGAAAACACT
Rpsl-k-5 2588 TTCTTGAAATACGTGACTGCCCCAAACTAGAGGGAAGTTTGCCGAATCACCTTCCTGCTCTGAAAACACT
Rpsl-k-2 2585 GTCTTGAAATACGTGACTGCCCCAAACTAGAGGGAAGTTTGCCGAATCACCTTCCTGCTCTGACAAAACT
Rpsl-k-4 2585 GTCTTGAAATACGTGACTGCCCCAAACTAGAGGGAAGTTTGCCGAATCACCTTCCTGCTCTGACAAAACT
consensus 2591 .************************************************************.**.**

Rpsl-k-3 2658 TACAATTAGAAATTGTGAGCTGCTTGGCTCTTCTCTCCCAACGGCTCCCGCCATTCAAAGTTTGGAGATA
Rpsl-k-1 2658 TACAATTAGAAATTGTGAGCTGCTTGGCTCTTCTCTCCCAACGGCTCCCGCCATTCAAAGTTTGGAGATA
Rpsl-k-5 2658 TACAATTAGAAATTGTGAGCTGCTTGGCTCTTCTCTCCCAACGGCTCCCGCCATTCAAAGTTTGGAGATA
Rpsl-k-2 2655 TGTGATTAGAAATTGCGAGCTGCTTGTCTCTTCTCTCCCAACGGCTCCCGCCATTCAAAGTTTGGAGATA
Rpsl-k-4 2655 TGTGATTAGAAATTGCGAGCTGCTTGTCTCTTCTCTCCCAACGGCTCCCGCCATTCAAAGTTTGGAGATA
consensus 2661 *.*.***********.**********.*******************************************

Rpsl-k-3 2728 CGTAAAAGCAATAAAGTAGCACTGCATGCGTTTCCTCTCTTGGTAGAAACTATAAAAGTAGAAGGAAGCC
Rpsl-k-1 2728 CGTAAAAGCAATAAAGTAGCACTGCATGCGTTTCCTCTCTTGGTAGAAACTATAAAAGTAGAAGGAAGCC
Rpsl-k-5 2728 CGTAAAAGCAATAAAGTAGCACTGCATGCGTTTCCTCTCTTGGTAGAAACTATAAAAGTAGAAGGAAGCC
Rpsl-k-2 2725 TGTAAAAGCAATAAAGTAGCACTGCATGCGTTTCCTCTCTTGGTAGAAACTATACAAGTAGAAGGAAGCC
Rpsl-k-4 2725 TGTAAAAGCAATAAAGTAGCACTGCATGCGTTTCCTCTCTTGGTAGAAACTATACAAGTAGAAGGAAGCC
consensus 2731 .****************************************************.***************

Rpsl-k-3 2798 CAATGGTGGAGTCCATGATGGAGGCCATCACAAACATCCAACCAACTTGTCTCCGGTCTTTAACATTAAG
Rpsl-k-1 2798 CAATGGTGGAGTCCATGATGGAGGCCATCACAAACATCCAACCAACTTGTCTCCGGTCTTTAACATTAAG
Rpsl-k-5 2798 CAATGGTGGAGTCCATGATGGAGGCCATCACAAACATCCAACCAACTTGTCTCCGGTCTTTAACATTAAG
Rpsl-k-2 2795 CAATGGTGGAGTCCGTGATCGAGGCCATCACTAACATCCAACCAACTTGTCTCCGGTCTTTAACATTAAG
Rpsl-k-4 2795 CAATGGTGGAGTCCGTGATCGAGGCCATCACTAACATCCAACCAACTTGTCTCCGGTCTTTAACATTAAG
consensus 2801 **************.****.**********.***************************************

Rpsl-k-3 2868 GGATTGCTCGTCAGCCGTGTCATTTCCGGGTGGTCGTTTACCTGAATCACTGAAGAGTCTGTATATCTCG
Rpsl-k-1 2868 GGATTGCTCGTCAGCCGTGTCATTTCCGGGTGGTCGTTTACCTGAATCACTGAAGAGTCTGTATATCTCG
Rpsl-k-5 2868 GGATTGCTCGTCAGCCGTGTCATTTCCGGGTGGTCGTTTACCTGAATCACTGAAGAGTCTGTATATCTCG
Rpsl-k-2 2865 GGATTGTTCGTCAGCCGTGTCATTTCCGGGTGGTCGTTTACCTGAATCACTGAAGAGTCTCAGTATCAAG
Rpsl-k-4 2865 GGATTGTTCGTCAGCCGTGTCATTTCCGGGTGGTCGTTTACCTGAATCACTGAAGAGTCTCAGTATCAAG
consensus 2871 ******.****************************************************.*****...*

Rpsl-k-3 2938 GATCTTAAAAAACTGGAATTCCCGACGCAACACAAACATGAGTTACTGGAAACACTGTCAATAGAAAGCA
Rpsl-k-1 2938 GATCTTAAAAAACTGGAATTCCCGACGCAACACAAACATGAGTTACTGGAAACACTGTCAATAGAAAGCA
Rpsl-k-5 2938 GATCTTAAAAAACTGGAATTCCCGACGCAACACAAACATGAGTTACTGGAAACACTGTCAATAGAAAGCA
Rpsl-k-2 2935 GATCTTAAAAAACTGGAATTCCCGACGCAACACAAACATGAGTTACTGGAAACACTGTCAATAGAAAGCA
Rpsl-k-4 2935 GATCTTAAAAAACTGGAATTCCCGACGCAACACAAACATGAGTTACTGGAAACACTGTCAATAGAAAGCA
consensus 2941 **********************************************************************

Rpsl-k-3 3008 GTTGTGATTCACTCACATCTCTTCCATTGGTTACCTTTCCAAATCTCAGAGATCTTGAAATCAGAAACTG
Rpsl-k-1 3008 GTTGTGATTCACTCACATCTCTTCCATTGGTTACCTTTCCAAATCTCAGAGATCTTGAAATCAGAAACTG
Rpsl-k-5 3008 GTTGTGATTCACTCACATCTCTTCCATTGGTTACCTTTCCAAATCTCAGAGATCTTGAAATCAGAAACTG
Rpsl-k-2 3005 GTTGTGATTCACTCACATCTCTTCCATTGGTTACCTTTCCAAATCTCAGATATCTCAGCATCGAAAGTG
Rpsl-k-4 3005 GTTGTGATTCACTCACATCTCTTCCATTGGTTACCTTTCCAAATCTCAGATATCTCAGCATCGAAAGTG
consensus 3011 **************************************************.****....***..***.**

Rpsl-k-3 3078 TGAAAATATGGAATCTCTTTTGGT---------------------------------------------
Rpsl-k-1 3078 TGAAAATATGGAATCTCTTTTGGT---------------------------------------------
Rpsl-k-5 3078 TGAAAATATGGAATCTCTTTTGGT---------------------------------------------
Rpsl-k-2 3075 TGAAAATATGGAATATCTTTTGGTTTCAGGGGCAGAGTCATTTAAGAGTCTGTGTTATTTGTTAATTTAC
Rpsl-k-4 3075 TGAAAATATGGAATATCTTTTGGTTTCAGGGGCAGAGTCATTTAAGAGTCTGTGTTATTTGTTAATTTAC
consensus 3081 *************.*.********
```

-continued

```
Rpsl-k-3    3102 ------------------ATCATTCTGGAGAGAAGGATTGCCTGCGCCCAACTTGATTACTTTCCAAGTGT
Rpsl-k-1    3102 ------------------ATCATTCTGGAGAGAAGGATTGCCTGCGCCCAACTTGATTACTTTCCAAGTGT
Rpsl-k-5    3102 ------------------ATCATTCTGGAGAGAAGGATTGCCTGCGCCCAACTTGATTACTTTCCAAGTGT
Rpsl-k-2    3145 AAATGCCCCAACTTTGTATCATTCTGGAGAGAAGGATTGCCTGCGCCCAACTTGATTACTTTCAGTGTTT
Rpsl-k-4    3145 AAATGCCCCAACTTTGTATCATTCTGGAGAGAAGGATTGCCTGCGCCCAACTTGATTACTTTCAGTGTTT
consensus   3151                  ********************************************...**.*

Rpsl-k-3    3155 GGGGCTCTGACAAGTTGAAGTCGTTGCCTGATGAGATGAGTACTCTTCTCCCAAAGTTAGAACGTCTCCT
Rpsl-k-1    3155 GGGGCTCTGACAAGTTGAAGTCGTTGCCTGATGAGATGAGTACTCTTCTCCCAAAGTTAGAACGTCTCCT
Rpsl-k-5    3155 GGGGCTCTGACAAGTTGAAGTCGTTGCCTGATGAGATGAGTACTCTTCTCCCAAAGTTAGAACGTCTCCT
Rpsl-k-2    3215 GGGGCTCTGACAAGTTGAAGTCGTTGCCTGATGAGATGAGTACTCTTCTCCCAAAGTTAGAAGATCTCAC
Rpsl-k-4    3215 GGGGCTCTGACAAGTTGAAGTCGTTGCCTGATGAGATGAGTACTCTTCTCCCAAAGTTAGAAGATCTCAC
consensus   3221 **************************************************************..****..

Rpsl-k-3    3225 CATATCCAACTGCCCAGAAATTGAGTCGTTTCCAAAACGGGGTATGCCACCTAACCTGAGAATAGTTTGG
Rpsl-k-1    3225 CATATCCAACTGCCCAGAAATTGAGTCGTTTCCAAAACGGGGTATGCCACCTAACCTGAGAATAGTTTGG
Rpsl-k-5    3225 CATATCCAACTGCCCAGAAATTGAGTCGTTTCCAAAACGGGGTATGCCACCTAACCTGAGAATAGTTTGG
Rpsl-k-2    3285 CATATCCAACTGCCCAGAAATTGAGTCCTTTCCAAAACGGGGTATGCCACCTAACCTGAGAAGAGTTGAG
Rpsl-k-4    3285 CATATCCAACTGCCCAGAAATTGAGTCCTTTCCAAAACGGGGTATGCCACCTAACCTGAGAAGAGTTGAG
consensus   3291 ***************************.******************************.****..*

Rpsl-k-3    3295 ATTTTCAATTGTGAGAAACTACTGAGCAGCCTAGCATGGCCATCCATGGGCATGCTTACTCATCTCTATG
Rpsl-k-1    3295 ATTTTCAATTGTGAGAAACTACTGAGCAGCCTAGCATGGCCATCCATGGGCATGCTTACTCATCTCTATG
Rpsl-k-5    3295 ATTTTCAATTGTGAGAAACTACTGAGCAGCCTAGCATGGCCATCCATGGGCATGCTTACTCATCTCTATG
Rpsl-k-2    3355 ATTGTCAATTGTGAGAAACTACTGAGCCGCCTAGCATGGCCATCCATGGGCATGCTTACTCATCTCAATG
Rpsl-k-4    3355 ATTGTCAATTGTGAGAAACTACTGAGCCGCCTAGCATGGCCATCCATGGGCATGCTTACTCATCTCAATG
consensus   3361 ***.******************************************************.***

Rpsl-k-3    3365 TTGGGGGTCGATGTGATGGCATCAAGTCCTTCCCTAAGGAGGGTTTGCTGCCTCCCTCCCTTACGTATCT
Rpsl-k-1    3365 TTGGGGGTCGATGTGATGGCATCAAGTCCTTCCCTAAGGAGGGTTTGCTGCCTCCCTCCCTTACGTATCT
Rpsl-k-5    3365 TTGGGGGTCGATGTGATGGCATCAAGTCCTTCCCTAAGGAGGGTTTGCTGCCTCCCTCCCTTACGTATCT
Rpsl-k-2    3425 TTGGGGGTCCATGTGATGGCATCAAGTCCTTCCCTAAGAGGGTTTGCTGCCTCCCTCCCTTACGTCTCT
Rpsl-k-4    3425 TTGGGGGTCCATGTGATGGCATCAAGTCCTTCCCTAAGAGGGTTTGCTGCCTCCCTCCCTTACGTCTCT
consensus   3431 *********.****************************.*******************.***

Rpsl-k-3    3435 GTATCTAAGTGGATTCTCAAATCTGGAGATGTTGGACTGCACGGGGCTTCTCCATCTCACATCCCTGCAA
Rpsl-k-1    3435 GTATCTAAGTGGATTCTCAAATCTGGAGATGTTGGACTGCACGGGGCTTCTCCATCTCACATCCCTGCAA
Rpsl-k-5    3435 GTATCTAAGTGGATTCTCAAATCTGGAGATGTTGGACTGCACGGGGCTTCTCCATCTCACATCCCTGCAA
Rpsl-k-2    3495 GTCTCTATATGACTTGTCAAATCTGGAGATGTTGGACTGCACGGGGCTTCTCCATCTCACATCCCTGCAA
Rpsl-k-4    3495 GTCTCTATATGAC   GTCAAATCTGGAGATGTTGGACTGCACGGGGCTTCTCCATCTCACATCCCTGCAA
consensus   3501 **.****..**.**.****************************************************

Rpsl-k-3    3505 CAATTAACCATAGACGGATGTCCTTTGCTGGAAAATATGGTGGGAGAAAGGCTTCCTGACTCTCTAATAA
Rpsl-k-1    3505 CAATTAACCATAGACGGATGTCCTTTGCTGGAAAATATGGTGGGAGAAAGGCTTCCTGACTCTCTAATAA
Rpsl-k-5    3505 CAATTAACCATAGACGGATGTCCTTTGCTGGAAAATATGGTGGGAGAAAGGCTTCCTGACTCTCTAATAA
Rpsl-k-2    3565 CAATTACAAATTTTTGGATGTCCAAAGCTGGAGAATATGGCTGGAGAAAGTCTTCCTTTTCTCTCTAATAA
Rpsl-k-4    3565 CAATTACAAATTTTTGGATGTCCAAAGCTGGAGAATATGGCTGGAGAAAGTCTTCCTTTTCTCTCTAATAA
consensus   3571 ******...**.....*********...******.*******.********.******.**********

Rpsl-k-3    3575 AATTAACCATAAAGAGTTGTCCTTTGCTGAAAAAACGATGCCGGAAGAAGCACCCTCAAATTTGGCCTAA
Rpsl-k-1    3575 AATTAACCATAAAGAGTTGTCCTTTGCTGAAAAAACGATGCCGGAAGAAGCACCCTCAAATTTGGCCTAA
Rpsl-k-5    3575 AATTAACCATAAAGAGTTGTCCTTTGCTGAAAAAACGATGCCGGAAGAAGCACCCTCAAATTTGGCCTAA
Rpsl-k-2    3635 AATTAACCATGGTGGAATGTCCTTTGCTGGAAAAACGATGCCGCATGAAGCACCCTCAAATTTGGCCTAA
Rpsl-k-4    3635 AATTAACCATGGTGGAATGTCCTTTGCTGGAAAAACGATGCCGCATGAAGCACCCTCAAATTTGGCCTAA
consensus   3641 **********...*...************.**********.*.*************************

Rpsl-k-3    3645 AATTTCCCACATCCCTGGCATTAAGGTTGACAATAGATGGATTTAG (SEQ ID NO:1)
Rpsl-k-1    3645 AATTTCCCACATCCCTGGCATTAAGGTTGACAATAGATGGATTTAG (SEQ ID NO:6)
Rpsl-k-5    3645 AATTTCCCACATCCCTGGCATTAAGGTTGACAATAGATGGATTTAG (SEQ ID NO:2)
Rpsl-k-2    3705 AGTTTCCCACATCCCTGGCATTAAGGTCGCAATAGATGGATTTAG  (SEQ ID NO:7)
Rpsl-k-4    3705 AGTTTCCCACATCCCTGGCATTAAGGTCGCAATAGATGGATTTAG  (SEQ ID NO:3)
consensus   3711 *.********************************.**************
```

Sequence alignment of 3' ends

```
Rpsl-k-2_3end  1 AGCCACCAAGGAGGACCAACAGGTATCTTCTAAGTCTAACCAACTAGAAAACTA  TCTGTCAAGGATA
Rpsl-k-4_3end  1 AGCCACCAAGGAGGACCAACAGGTATCTTCTAAGTCTAACCAACTAGAAAACTA  TCTGTCAAGGATA
Rpsl-k-3_3end  1 AGCCACCAAGGAGGACCAACAGGTATCTTCTAAGTCTAACCAACTAGAAAACTAGTTCTGTCAAGGATA
Rpsl-k-5_3end  1 AGCCACCAAGGAGGACCAACAGGTATCTTCTAAGTCTAACCAACTAGAAAACTAGTTCTGTCAAGGATA
Rpsl-k-1_3end  1 AGCCACCAAGGAGGACCAACAGGTATCTTCTAAGTCTAACCAACTAGAAAACTAGTTCTGTCAAGGATA
consensus      1 ******************************************************.**************

Rpsl-k-2_3end 71 TGTTTCATTTCATGTCTTTCTACTTTTACGTTTTACTAAATCCAATTCATTCTGAAATGGAAATTGACCT
Rpsl-k-4_3end 71 TGTTTCATTTCATGTCTTTCTACTTTTACGTTTTACTAAATCCAATTCATTCTGAAATGGAAATTGACCT
Rpsl-k-3_3end 71 TGTTTCATTTCATGTCTTTCTCCTTTTACGTTTTACTAAATCCAATTCATTCTGAAATGGAAATTGACCT
Rpsl-k-5_3end 71 TGTTTCATTTCATGTCTTTCTCCTTTTACGTTTTACTAAATCCAATTCATTCTGAAATGGAAATTGACCT
Rpsl-k-1_3end 71 TGTTTCATTTCATGTCTTTCTCCTTTTACGTTTTACTAAATCCAATTCATTCTGAAATGGAAATTGACCT
consensus     71 *********************.***********************************************

Rpsl-k-2_3end 141 TGTATATATGTTACTGAATCTACAGAGAATCAACAAATCATCAAAGGCAACGTGGAAATTGACCTTGTAT
Rpsl-k-4_3end 141 TGTATATATGTTACTGAATCTACAGAGAATCAACAAATCATCAAAGGCAACGTGGAAATTGACCTTGTAT
Rpsl-k-3_3end 141 TGTATATATGTTACTGAATCTACAGAGAATCAACAAATCATCAAAGGCAACGTGGAAATTGACCTTGTAT
Rpsl-k-5_3end 141 TGTATATATGTTACTGAATCTACAGAGAATCAACAAATCATCAAAGGCAACGTGGAAATTGACCTTGTAT
Rpsl-k-1_3end 141 TGTATATATGTTACTGAATCTACAGAGAATCAACAAATCATCAAAGGCAACGTGGAAATTGACCTTGTAT
consensus    141 **********************************************************************
```

-continued

```
Rps1-k-2_3end 211 ATATGTTTCGAAGAAGTAACGATACAGGTACTAAGTAACAACATTGACAAATACTTAAATATAATGATTC
Rps1-k-4_3end 211 ATATGTTTCGAAGAAGTAACGATACAGGTACTAAGTAACAACATTGACAAATACTTAAATATAATGATTC
Rps1-k-3_3end 211 ATATGTTTCGAAGAAGTAACGATACAGGTACTAAGTAACAACATTGATAAATACTTAAATATAATGATTC
Rps1-k-5_3end 211 ATATGTTTCGAAGAAGTAACGATACAGGTACTAAGTAACAACATTGATAAATACTTAAATATAATGATTC
Rps1-k-1_3end 211 ATATGTTTCGAAGAAGTAACGATACAGGTACTAAGTAACAACATTGATAAATACTTAAATATAATGATTC
consensus     211 *****************************************.**************************

Rps1-k-2_3end 281 TCCGGAAAAATGTTACACATCAGTCTTGTTATATTCTAACTTAATTTCTCCTTAAGATTATTGAGGCCAG
Rps1-k-4_3end 281 TCCGGAAAAATGTTACACATCAGTCTTGTTATATTCTAACTTAATTTCTCCTTAAGATTATTGAGGCCAG
Rps1-k-3_3end 281 TCCGGAAAAATGTTACACATCAGTATTGTTATATTCTAACTTAATTTCTCCTTAAGATTATTGAGGCCAG
Rps1-k-5_3end 281 TCCGGAAAAATGTTACACATCAGTATTGTTATATTCTAACTTAATTTCTCCTTAAGATTATTGAGGCCAG
Rps1-k-1_3end 281 TCCGGAAAAATGTTACACATCAGTATTGTTATATTCTAACTTAATTTCTCCTTAAGATTATTGAGGCCAG
consensus     281 ************************.********************************************

Rps1-k-2_3end 351 AGTGAAAATGACCGTGGGAAACTTATTTTTGTTTTTCAGATATGGTTGATTGGCCCGGAGAAACTGTACC
Rps1-k-4_3end 351 AGTGAAAATGACCGTGGGAAACTTATTTTTGTTTTTCAGATATGGTTGATTGGCCCGGAGAAACTGTACC
Rps1-k-3_3end 351 AGTGAAAATGACCGTGGGAAACTTATTTTTGTTTTTCAGATATGGTTGATTGGCCCGGAGAAACTGTACC
Rps1-k-5_3end 351 AGTGAAAATGACCGTGGGAAACTTATTTTTGTTTTTCAGATATGGTTGATTGGCCCGGAGAAACTGTACC
Rps1-k-1_3end 351 AGTGAAAATGACCGTGGGAAACTTATTTTTGTTTTTCAGATATGGTTGATTGGCCCGGAGAAACTGTACC
consensus     351 **********************************************************************

Rps1-k-2_3end 421 TACCCATGAATCTAAGTTCAAATTTGAACTAGTGCTAAATGTAACTTTTAATTTAATTGATGTCAAATTG
Rps1-k-4_3end 421 TACCCATGAATCTAAGTTCAAATTTGAACTAGTGCTAAATGTAACTTTTAATTTAATTGATGTCAAATTG
Rps1-k-3_3end 421 TACCCATGAATCTAAGTTCAAATTTGAACTAGTGCTAAATGTAACTTTTAATTTAATTGATGTCAAATTG
Rps1-k-5_3end 421 TACCCATGAATCTAAGTTCAAATTTGAACTAGTGCTAAATGTAACTTTTAATTTAATTGACGTCAAATTG
Rps1-k-1_3end 421 TACCCATGAATCTAAGTTCAAATTTGAACTAGTGCTAAATGTAACTTTTAATTTAATTGACGTCAAATTG
consensus     421 ***********************************************************.********

Rps1-k-2_3end 491 ACACTTTCTCAATAGCTGAATTTTTATTTGTGAGGTTTTTCGTTGGGTACAATGTGAAGGATGAAAAGGT
Rps1-k-4_3end 491 ACACTTTCTCAATAGCTGAATTTTTATTTGTGAGGTTTTTCGTTGGGTACAATGTGAAGGATGAAAAGGT
Rps1-k-3_3end 491 ACACTTTCTCAATAGCTGAATTTTTATTTGTGAGGTTTTTCGTTGGGTACAATGTGAAGGATGAAAAGGT
Rps1-k-5_3end 491 ACACTTTCTCAATAGCTAAATTTTTATTTGTGAGGTTTTTTGTTAGGTACAATGTGAAGGATGAAAAGGT
Rps1-k-1_3end 491 ACACTTTCTCAATAGCTAAATTTTTATTTGTGAGGTTTTTTGTTAGGTACAATGTGAAGGATGAAAAGGT
consensus     491 *****************.*********************.***.************************

Rps1-k-2_3end 561 GTACCAAGTGAACTTTAGAAGGATTGGATGATTTCAGCTTATCTCTTATTCCCTGTCCTATAAATTAATA
Rps1-k-4_3end 561 GTACCAAGTGAACTTTAGAAGGATTGGATGATTTCAGCTTATCTCTTATTCCCTGTCCTATAAATTAATA
Rps1-k-3_3end 561 GTACCAAGTGAACTTTAGAAGGATTGGATGATTTCAGCTTATCTCTTATTCCCTGTCCTATAAATTAATA
Rps1-k-5_3end 561 GTACCAAGTGAACTTTAGAAGGATTGGATGATTTCAGCTTATCTCTTATCTCCTGTCCTATAAATTAATA
Rps1-k-1_3end 561 GTACCAAGTGAACTTTAGAAGGATTGGATGATTTCAGCTTATCTCTTATCTCCTGTCCTATAAATTAATA
consensus     561 *************************************************...****************

Rps1-k-2_3end 631 ATGGTATGATTATTCTAAAAATATGATAGATATGTAGATAAGTAAGAATTGATAAAAGCATAATAAATAT
Rps1-k-4_3end 631 ATGGTATGATTATTCTAAAAATATGATAGATATGTAGATAAGTAAGAATTGATAAAAGCATAATAAATAT
Rps1-k-3_3end 631 ATGGTATGATTATTCTAAAAATATGATAGATATGTAGATAAGTAAGAATTGATAAAAGCATAATAAATAT
Rps1-k-5_3end 631 GTGGTATGATTATTCTAAAAATATGATAGATATGTAGATACGTAAGAATTGATAAAAGCATAATAAATAT
Rps1-k-1_3end 631 GTGGTATGATTATTCTAAAAATATGATAGATATGTAGATACGTAAGAATTGATAAAAGCATAATAAATAT
consensus     631 .***************************************.****************************

Rps1-k-2_3end 701 ACAATTGCAATTCGGTAAACTGAAGAACATACATACTTCTTAGACATTGCTAAAAACAAAATCAAAAAAT
Rps1-k-4_3end 701 ACAATTGCAATTCGGTAAACTGAAGAACATACATACTTCTTAGACATTGCTAAAAACAAAATCAAAAAAT
Rps1-k-3_3end 701 ACAATTGCAATTCGGTAAACTGAAGAACATACATACTTCTTAGACATTGCTAAAAACAAAATCAAAAAAT
Rps1-k-5_3end 701 ACAATTGCAATTCGGTAAATTGAAGAACATACATACTTCTTAGACATTGCTAAAAACAAAATCAAAAAAT
Rps1-k-1_3end 701 ACAATTGCAATTCGGTAAATTGAAGAACATACATACTTCTTAGACATTGCTAAAAACAAAATCAAAAAAT
consensus     701 *******************.************************************************

Rps1-k-2_3end 771 TGTAGATCATTTTTTTCCTATTGTTCACAAATAAGAATGGTACTATCAATGATCAATCTCATTTCTTTCT
Rps1-k-4_3end 771 TGTAGATCATTTTTTTCCTATTGTTCACAAATAAGAATGGTACTATCAATGATCAATCTCATTTCTTTCT
Rps1-k-3_3end 771 TGTAGATCATTTTTTTCCTATTGTTCACAAATAAGAATGGTACTATCAATGATCAATCTCATTTCTTTCT
Rps1-k-5_3end 771 TGTAGATCATTTTTT-CCTATTGTTCACAAATAAGAATGGTACTATCAATGATCAATCTCATTTCTTTCT
Rps1-k-1_3end 771 TGTAGATCATTTTTT-CCTATTGTTCACAAATAAGAATGGTACTATCAATGATCAATCTCATTTCTTTCT
consensus     771 ***************.******************************************************

Rps1-k-2_3end 841 TGAAATTATCTATAAACAAAACAATTTTTCATATT-GGTTCATCAAGAAACAATACTTTTTATATTTCTAT
Rps1-k-4_3end 841 TGAAATTATCTATAAACAAAACAATTTTTCATATT-GGTTCATCAAGAAACAATACTTTTTATATTTCTAT
Rps1-k-3_3end 841 TGAAATTATCTATAAACAAAACAATTTTTCATATT-GGTTCATCAAGAAACAATACTTTTTATATTTCTAT
Rps1-k-5_3end 840 TGAAATTATCTATAAACAAAACAATTTTTCATATTTGGTTCATCAAGAAACAATACTTTTTATATTTCTAT
Rps1-k-1_3end 840 TGAAATTATCTATAAACAAAACAATTTTTCATATTTGGTTCATCAAGAAACAATACTTTTTATATTTCTAT
consensus     841 ***********************************.********************************

Rps1-k-2_3end 910 ATTATACTTACTTCTATGTTACATGTCACTATATTTGATTATCATAATTTTTTTTAAA-GAATTGGTCA
Rps1-k-4_3end 910 ATTATACTTACTTCTATGTTACATGTCACTATATTTGATTATCATAATTTTTTTTAAA-GAATTGGTCA
Rps1-k-3_3end 910 ATTATACTTACTTCTATGTTACATGTCACTATATTTGATTATCATAATTTTTTTTAAA-GAATTGGTCA
Rps1-k-5_3end 910 ATTATATTTACTTCTATGTTACATGTCACTATATTTGATTATCATAATTTTTTTTAAAAGAATTGGTCA
Rps1-k-1_3end 910 ATTATATTTACTTCTATGTTACATGTCACTATATTTGATTATCATAATTTTTTTTAAAAGAATTGGTCA
consensus     911 ******.*************************************************.***********

Rps1-k-2_3end 979 CTTCACATATATGTATCAG------------ATATATTGGTATCAGATATAGATGCATGAAGCAAATTAA
Rps1-k-4_3end 979 CTTCACATATATGTATCAG------------ATATATTGGTATCAGATATAGATGCATGAAGCAAATTAA
Rps1-k-3_3end 979 CTTCACATATATGTATCAG------------ATATATTGGTATCAGATATAGATGCATGAAGCAAATTAA
Rps1-k-5_3end 980 CTTTACATATATGTACCAGTGAAATATATCAATATATTGGTATCGGATATAGATGCATGAAGCAAATTAA
Rps1-k-1_3end 980 CTTTACATATATGTACCAGTGAAATATATCAATATATTGGTATCGGATATAGATGCATGAAGCAAATTAA
consensus     981 ***.***********.***            ****************.********************
```

-continued

```
Rps1-k-2_3end 1037 AGTATCAGTACTTTGTAGCAAAACACATTCTTCAAATCATGACATGAGGTAAAAAAAAATAAGATGATAT
Rps1-k-4_3end 1037 AGTATCAGTACTTTGTAGCAAAACACATTCTTCAAATCATGACATGAGGTAAAAAAAAATAAGATGATAT
Rps1-k-3_3end 1037 AGTATCAGTACTTTGTAGCAAAACACATTCTTCAAATCATGACATGAGGTAAAAAAAAATAAGATGATAT
Rps1-k-5_3end 1050 AGTATCAGTACTTTGTAGCAAAACACATTCTTCAAATCATGACATGAGGTAAAAAAAATAT--GATATAT
Rps1-k-1_3end 1050 AGTATCAGTACTTTGTAGCAAAACACATTCTTCAAATCATGACATGAGGTAAAAAAAATAT--GATATAT
consensus     1051 **********************************************************.**..*******

Rps1-k-2_3end 1107 TTTTGTAAGTATTGGAAAAAAAAAGA---GTAAAGCTTCTGAAATCAAAGAGACACTAATTTTCCACAAC
Rps1-k-4_3end 1107 TTTTGTAAGTATTGGAAAAAAAAAGA---GTAAAGCTTCTGAAATCAAAGAGACACTAATTTTCCACAAC
Rps1-k-3_3end 1107 TTTTGTAAGTATTGGAAAAAAAAAGA---GTAAAGCTTCTGAAATCAAAGAGACACTAATTTTCCACAAC
Rps1-k-5_3end 1118 TTTTGTAAGTATTGGAAAAAAAAAAAAAGTAAAGCTTCTGAAATCAAAGAGACACTAATTTTCCACAAC
Rps1-k-1_3end 1118 TTTTGTAAGTATTGGAAAAAAAAAAAAAGTAAAGCTTCTGAAATCAAAGAGACACTAATTTTCCACAAC
consensus     1121 ************************.*  ******************************************

Rps1-k-2_3end 1174 ATCCTTCAATTGGGCCCAAGCTTCCTTTCCTATGGACAAATAACTGGTTGTTAGTGCCAGCCTTTTCTTT
Rps1-k-4_3end 1174 ATCCTTCAATTGGGCCCAAGCTTCCTTTCCTATGGACAAATAACTGGTTGTTAGTGCCAGCCTTTTCTTT
Rps1-k-3_3end 1174 ATCCTTCAATTGGGCCCAAGCTTCCTTTCCTATGGACAAATAACTGGTTGTTAGTGCCAGCCTTTTCTTT
Rps1-k-5_3end 1188 ATCCTTCAATTGGGCCCAAGCTTCCTTTCCTATTGACAAATAACTGGTTGTTAGTGCCAGCTTTTTCTTT
Rps1-k-1_3end 1188 ATCCTTCAATTGGGCCCAAGCTTCCTTTCCTATTGACAAATAACTGGTTGTTAGTGCCAGCTTTTTCTTT
consensus     1191 *********************************.*************************.********

Rps1-k-2_3end 1244 TTACCAGTTTTCCATTGATGGTTAAAAGCTATTATGAACCTGTCACTCCTTAAAATTTCCACCAAAGTTT
Rps1-k-4_3end 1244 TTACCAGTTTTCCATTGATGGTTAAAAGCTATTATGAACCTGTCACTCCTTAAAATTTCCACCAAAGTTT
Rps1-k-3_3end 1244 TTACCAGTTTTCCATTGATGGTTAAAAGCTATTATGAACCTGTCACTCCTTAAAATTTCCACCAAAGTTT
Rps1-k-5_3end 1258 TTTCTAGTTTTCCATTGATGGTTAAAAGCTAAATGAACCTGTCACTCCTTAAAATTTCCACCAAAGTTT
Rps1-k-1_3end 1258 TTTCTAGTTTTCCATTGATGGTTAAAAGCTAATATGAACCTGTCACTCCTTAAAATTTCCACCAAAGTTT
consensus     1261 **.*.*************************.*************************************

Rps1-k-2_3end 1314 GGTAAATAAATATATAGGAGAGTGAATAATACAAGTCTTGCATTCTATCTCTAAGTTATTAGGTATATGA
Rps1-k-4_3end 1314 GGTAAATAAATATATAGGAGAGTGAATAATACAAGTCTTGCATTCTATCTCTAAGTTATTAGGTATATGA
Rps1-k-3_3end 1314 GGTAAATAAATATATAGGAGAGTGAATAATACAAGTCTTGCATTCTATCTCTAAGTTATTAGGTATATGA
Rps1-k-5_3end 1328 GGTAAATAAATATATAGGAGAGTGAATAATGCAAGCCTTGCATTCTATCTCTAAGTTACTAGGTATATGA
Rps1-k-1_3end 1328 GGTAAATAAATATATAGGAGAGTGAATAATGCAAGCCTTGCATTCTATCTCTAAGTTACTAGGTATATGA
consensus     1331 ******************************.****.*********************.*********

Rps1-k-2_3end 1384 AACAGGTATGGGTATTTGGTTTTAGAAGGTATGTGGTTCATCACTATTTATATTATTACTACAAGAACCA
Rps1-k-4_3end 1384 AACAGGTATGGGTATTTGGTTTTAGAAGGTATGTGGTTCATCACTATTTATATTATTACTACAAGAACCA
Rps1-k-3_3end 1384 AACAGGTATGGGTATTTGGTTTTAGAAGGTATGTGGTTCATCACTATTTATATTATTACTACAAGAACCA
Rps1-k-5_3end 1398 AACAGGTATGGGTA--TGGTTTTAGAAGGTATGTGGTTCATCACTATTTATATTTTTACTACAAGAACCA
Rps1-k-1_3end 1398 AACAGGTATGGGTA--TGGTTTTAGAAGGTATGTGGTTCATCACTATTTATATTTTTACTACAAGAACCA
consensus     1401 **************  *************************************.*************

Rps1-k-2_3end 1454 GGTAAACTTTATTATGGTACAGTAAGTTTGGTGTGAG-TTGTAACTACGTTATATCCATCTCACTTAGCA
Rps1-k-4_3end 1454 GGTAAACTTTATTATGGTACAGTAAGTTTGGTGTGAG-TTGTAACTACGTTATATCCATCTCACTTAGCA
Rps1-k-3_3end 1454 GGTAAACTTTATTATGGTACAGTAAGTTTGGTGTGAG-TTGTAACTACGTTATATCCATCTCACTTAGCA
Rps1-k-5_3end 1466 GGTAAACTTTATTATGGTACAGTAAATTTAGTGTGAGGTTGTAACTACGTTATATCCATCTAACTTAGCA
Rps1-k-1_3end 1466 GGTAAACTTTATTATGGTACAGTAAATTTAGTGTGAGGTTGTAACTACGTTATATCCATCTAACTTAGCA
consensus     1471 ************************.***.******* ***********************.********

Rps1-k-2_3end 1523 CGATAATTAAATTTAAAAGCAAAAAGATAAGAAAAAGGCCAATCTAACAATTGTTACCTCTCTTGCATGA
Rps1-k-4_3end 1523 CGATAATTAAATTTAAAAGCAAAAAGATAAGAAAAAGGCCAATCTAACAATTGTTACCTCTCTTGCATGA
Rps1-k-3_3end 1523 CGATAATTAAATTTAAAAGCAAAAAGATAAGAAAAAGGCCAATCTAACAATTGTTACCTCTCTTGCATGA
Rps1-k-5_3end 1536 CGATAATTAAATTTAAAAGCAAAAAGATAAGAAAAAGGCCAATCTAACAATTGTTACCTCTCTTGCATGA
Rps1-k-1_3end 1536 CGATAATTAAATTTAAAAGCAAAAAGATAAGAAAAAGGCCAATCTAACAATTGTTACCTCTCTTGCATGA
consensus     1541 *******************************************************************

Rps1-k-2_3end 1593 CAAAATCAGAAACAAAAGTCCCACTCTTTCCTCCATGGTGCCTGTAATTAACAAGCACTTCAAAAACCAA
Rps1-k-4_3end 1593 CAAAATCAGAAACAAAAGTCCCACTCTTTCCTCCATGGTGCCTGTAATTAACAAGCACTTCAAAAACCAA
Rps1-k-3_3end 1593 CAAAATCAGAAACAAAAGTCCCACTCTTTCCTCCATGGTGCCTGTAATTAACAAGCACTTCAAAAACCAA
Rps1-k-5_3end 1606 AAAAATCAGAAACAAAACCCCCACTCTTTCCTCCATGGTGCCTGTAATTAACAAGCACTTCAAAATCAA
Rps1-k-1_3end 1606 AAAAATCAGAAACAAAACCCCCACTCTTTCCTCCATGGTGCCTGTAATTAACAAGCACTTCAAAATCAA
consensus     1611 .************.***.********************************************..***

Rps1-k-2_3end 1663 TGTTAATTAATTAATTTCCATAAAAAAAAAAAGGCAAAAGCCAATGAAATTTAAGGGGTACAACAAAGAT
Rps1-k-4_3end 1663 TGTTAATTAATTAATTTCCATAAAAAAAAAAAGGCAAAAGCCAATGAAATTTAAGGGGTACAACAAAGAT
Rps1-k-3_3end 1663 TGTTAATTAATTAATTTCCATAAAAAAAAAAAGGCAAAAGCCAATGAAATTTAAGGGGTACAACAAAGAT
Rps1-k-5_3end 1676 TGTTAATTAATTAATTTCCATAACAAAAAAAGACAAGCTAATGAAATTTAAGGGGTACAACAAAGAT
Rps1-k-1_3end 1676 TGTTAATTAATTAATTTCCATAACAAAAAAAGACAAGCTAATGAAATTTAAGGGGTACAACAAAGAT
consensus     1681 **********************.********.****.**************************

Rps1-k-2_3end 1733 TTGTAGAACGATCATTAATATTAGTGCAACGCACCATGATGAAGTGCATGACATAATAATAATGTGAAC
Rps1-k-4_3end 1733 TGTAGAACGATCATTAATATTAGTGCAACGCACCATGATGAAGTGCATGACATAATAATAATGTGAAC
Rps1-k-3_3end 1733 TTGTAGAACGATCATTAATATTAGTGCAACGCACCATGATGAAGTGCATGACATAATAATAATGTGGAAC
Rps1-k-5_3end 1746 TTGTAGAACGATCATTAATATTAGTGCAACTCATCATGATGAAGTGCATGACATAATAATAATGTGAAAC
Rps1-k-1_3end 1746 TTGTAGAACGATCATTAATATTAGTGCAACACATCATGATGAAGTGCATGACATAATAATAATGTGAAAC
consensus     1751 ******************************.**.*************************.***

Rps1-k-2_3end 1803 CAATCATGATAAGAACAGAAATAAATCAATGCAATTGCATGATCAGAAAATAACGAGGCGATATATCAT
Rps1-k-4_3end 1803 CAATCATGATAAGAACAGAAATAAATCAATGCAATTGCATGATCAGAAAATAACGAGGCGATATATCAT
Rps1-k-3_3end 1803 CAATCATGATAAGAACAGAAATAAATCAATGCAATTGCATGATCAGAAAATAACGAGGCGATATATCAT
Rps1-k-5_3end 1816 CAATCATGATAAGAACAGAAATAAATCAGTGCAATTACATGATTAGAAAATAAAGAGGCGATATATCAT
Rps1-k-1_3end 1816 CAATCATGATAAGAACAGAAATAAATCAGTGCAATTACATGATTAGAAAATAAAGAGGCGATATATCAT
consensus     1821 ****************************.*******.*****.********.***************

Rps1-k-2_3end 1873 GTTCCTATTGAT-AGACAATAGGACAACGTGTTAAAGAAATGTGTCAAGTGCAACAATGAGGGAACGGAG
Rps1-k-4_3end 1873 GTTCCTATTGATCAGACAATAGGACAACGTGTTAAAGAAATGTGTCAAGTGCAACAATGAGGGAACGGAG
Rps1-k-3_3end 1873 GTTCCTATTGATCAGACAATAGGACAACGTGTTAAAGAAATGTGTCAAGTGCAACAATGAGGGAACGGAG
Rps1-k-5_3end 1886 ATTCCTATTGATCAGACAATATGACAACGTGTTAAACAAATGTGTCAGGTGCAATAATGAGGGGATAGAG
Rps1-k-1_3end 1886 ATTCCTATTGATCAGACAATATGACAACGTGTTAAACAAATGTGTCAGGTGCAATAATGAGGGGATAGAG
consensus     1891 .***********.********.*************.***********.******.*********.*.***
```

-continued

```
Rps1-k-2_3end  1942 AAGAGAAGGATGATAAAGAATGTGGTTATGACTTCTACAAAGTCCAATTATTTACTTTTTTAATTTTTTA
Rps1-k-4_3end  1943 AAGAGAAGGATGATAAAGAATGTGGTTATGACTTCTACAAAGTCCAATTATTTACTTTTTTAATTTTTTA
Rps1-k-3_3end  1943 AAGAGAAGGATGATAAAGAATGTGGTTATGACTTCTACAAAGTCCAATTATTTACTTTTTTAATTTTTTA
Rps1-k-5_3end  1956 AAGAGAAGGATGATAAAGAATGTGGTTATGACTTCTACAAAGTCGAATTATTTACTTTTTTAATTTTTTA
Rps1-k-1_3end  1956 AAGAGAAGGATGATAAAGAATGTGGTTATGACTTCTACAAAGTCGAATTATTTACTTTTTTAATTTTTTA
consensus      1961 ********************************************.************************

Rps1-k-2_3end  2012 TATTTTCCTTTTCACTTTCCTAATAGTTGTCGGATTAAAAGGAGTTTATGGAGTAGATTAGATTGGTTTT
Rps1-k-4_3end  2013 TATTTTCCTTTTCACTTTCCTAATAGTTGTCGGATTAAAAGGAGTTTATGGAGTAGATTAGATTGGTTTT
Rps1-k-3_3end  2013 TATTTTCCTTTTCACTTTCCTAATAGTTGTCGGATTAAAAGGAGTTTATGGAGTAGATTAGATTGGTTTT
Rps1-k-5_3end  2026 TATTTTCCTTTTCACTTTTCTAATAGTTGGCCGATTAAGAGGAGTTTATAGAGTAGATTAAATTGGTTTT
Rps1-k-1_3end  2026 TATTTTCCTTTTCACTTTTCTAATAGTTGTCGATTAAGAGGAGTTTATAGAGTAGATTAAATTGGTTTT
consensus      2031 ******************.***********..*******.********.**********.*.********

Rps1-k-2_3end  2082 GAAAAAGAGAAATATCATCTGATACAATTTTTAGTTTTCTTAATTTATTGTTCAATTGATGTAGTTTAAA
Rps1-k-4_3end  2083 GAAAAAGAGAAATATCATCTGATACAATTTTTAGTTTTCTTAATTTATTGTTCAATTGATGTAGTTTAAA
Rps1-k-3_3end  2083 GAAAAAGAGAAATATCATCTGATACAATTTTTAGTTTTCTTAATTTATTGTTCAATTGATGTAG------
Rps1-k-5_3end  2096 GAAAAAGAGAAATATCATCTTATACAATTTTTGGTTTTCTTAATTCATTGTTCAATTGATGTAGTTTAAA
Rps1-k-1_3end  2096 GAAAAAGAGAAATATCATCTTATACAATTTTTGGTTTTCTTAATTCATTGTTCAATTGATGTAGTTTAAA
consensus      2101 ********************.***********.************.********************....

Rps1-k-2_3end  2152 AAGTTGCACTAACTGAAGTGGAAAAGCAACATAGGTTGGCATAATGGAAT  (SEQ ID NO:162)
Rps1-k-4_3end  2153 AAGTTGCACTAACTGAAGTGGAAAAGCAACATAGGTTGGCAT--------  (SEQ ID NO:166)
Rps1-k-3_3end       --------------------------------------------------  (SEQ ID NO:164)
Rps1-k-5_3end  2166 ATTAAATAGATTTAA--TAAGTTTGGATTGATCTCCA-------------  (SEQ ID NO:168)
Rps1-k-1_3end  2166 ATTAAATAGATTTAA--TAAGTTTGGATTGATCTCCA-------------  (SEQ ID NO:160)
consensus      2171 ..   ..   ...   ..   ...   ...   ....
```

Alignment of the predicted amino acid sequences showing the variable residues

```
Rps1-k-5    1 MAAALVGGAFLSAFLDVLFDRLASPDFVDLILGKKLSKKLLRKLETTLRVVGAVLDDAEKKQITNTNVKH
Rps1-k-1    1 MAAALVGGAFLSAFLDVLFDRLASPDFVDLILGKKLSKKLLRKLETTLRVVGAVLDDAEKKQITNTNVKH
Rps1-k-3    1 MAAALVGGAFLSAFLDVLFDRLASPDFVDLILGKKLSKKLLRKLETTLRVVGAVLDDAEKKQITNTNVKH
Rps1-k-2    1 MAAALVGGAFLSAFLDVWFDRLASPEFVDLIRGKKLSKKLIQKLETTLRVVGAVLDDAEKKQITNTNVKH
Rps1-k-4    1 MAAALVGGAFLSAFLDVWFDRLASPEFVDLIRGKKLSKKLIQKLETTLRVVGAVLDDAEKKQITNTNVKH
consensus   1 *****************.******.*****.********.*****************************

Rps1-k-5   71 WLNALKDAVYEADDLLDHVFTKAATQNKVRNLFSRFSDRKIVSKLEDIVVTLESHLKLKESLDLKESAVE
Rps1-k-1   71 WLNALKDAVYEADDLLDHVFTKAATQNKVRNLFSRFSDRKIVSKLEDIVVTLESHLKLKESLDLKESAVE
Rps1-k-3   71 WLNALKDAVYEADDLLDHVFTKAATQNKVRNLFSRFSDRKIVSKLEDIVVTLESHLKLKCSLDLKESAVE
Rps1-k-2   71 WLNDLKHAVYEADDLLDHVFTKAATQNKVRELESRESDRKIVSKLEDIVVTLESHLKLKESLDLKESAVE
Rps1-k-4   71 WLNDLKHAVYEADDLLDHVFTKAATQNKVRELESRESDRKIVSKLEDIVVTLESHLKLKESLDLKESAVE
consensus  71 ***.**.**********************..**.******************** *************

Rps1-k-5  141 NLSWKAPSTSLEDGSHIYGREKDREAIIKLLSEDNSDGSEVSVVPIVGMGGVGKTTLAQLVYNDENLKEK
Rps1-k-1  141 NLSWKAPSTSLEDGSHIYGREKDREAIIKLLSEDNSDGSEVSVVPIVGMGGVGKTTLAQLVYNDENLKEK
Rps1-k-3  141 NLSWKATSTSLEDGSHIYGREKDREAIIKLLSEDNSDGSEVSVVPIVGMGGVGKTTLAQLVYNDENLKEK
Rps1-k-2  141 NLSWKAPSTSLEDGSHIYGREKDREAIIKLISEDNSDGREVSVVPIVGMGGVGKTTLAQLVYNDENLKQK
Rps1-k-4  141 NLSWKAPSTSLEDGSHIYGREKDREAIIKLLSEDNSDGREVSVVPIVGMGGVGKTTLAQLVYNDENLKQK
consensus 141 ******.***********************.******.******************************..

Rps1-k-5  211 FDFDFKAWVCVSQEFDVLKVTKTIIQAVTGNPCKLNDLNLLHLELMDKLKDKKFLIVLDDVWTEDYVDWS
Rps1-k-1  211 FDFDFKAWVCVSQEFDVLKVTKTIIQAVTGNPCKLNDLNLLHLELMDKLKDKKFLIVLDDVWTEDYVDWS
Rps1-k-3  211 FDFDFKAWVCVSQEFDVLKVTKTIIQAVTGNPCKLNDLNLLHLELMDKLKDKKFLIVLDDVWTEDYVDWS
Rps1-k-2  211 FDFDFKAWVCVSQEFDVLKVTKTIIEAVTGKACKLNDLNLLHLELMDKLKDKKFLIVLDDVWTEDYVDWR
Rps1-k-4  211 FDFDFKAWVCVSQEFDVLKVTKTIIEAVTGKACKLNDLNLLHLELMDKLKDKKFLIVLDDVWTEDYVDWR
consensus 211 *************************.****..************************************.

Rps1-k-5  281 LLKKPFQCGIIRRSKILLTTRSEKTASVVQTVQTYHLNQLSNEDCWSVTANHACLSLESNE-NTTLEKIG
Rps1-k-1  281 LLKKPFQCGIIRRSKILLTTRSEKTASVVQTVQTYHLNQLSNEDCWSVFANHACLSLESNE-NTTLEKIG
Rps1-k-3  281 LLKKPFQCGIIRRSKILLTTRSEKTASVVQTVQTYHLNQLSNEDCWSVTANHACLSLESNE-NTTLEKIG
Rps1-k-2  281 LLKKPFNRGIIRRSKILLTTRSEKTASVVQTVHTYHLNQLSNEDCWSVTANHACLSTESNENTATLEKIG
Rps1-k-4  281 LLKKPFNRGIIRRSKILLTTRSEKTASVVQTVHTYHLNQLSNEDCWSVTANHACLSTESNENTATLEKIG
consensus 281 ******..*******************************.*******************.****..******

Rps1-k-5  350 KEIVKKCDGLPLAAQSLGGMLRRKHDIGDWYNILNSDIWELSESECKVIPALRLSYHYLPPHLKRCFVYC
Rps1-k-1  350 KEIVKKCDGLPLAAQSLGGMLRRKHDIGDWYNILNSDIWELSESECKVIPALRLSYHYLPPHLKRCFVYC
Rps1-k-3  350 KEIVKKCDGLPLAAQSLGGMLRRKHDIGDWYNILNSDIWELSESECKVIPALRLSYHYLPPHLKRCFVYC
Rps1-k-2  351 KEIVKKCNGLPLAAESLGGMLRRKHDIGDWNNILNSDIWELSESECKVIPALRLSYHYLPPHLKRCFVYC
Rps1-k-4  351 KEIVKKCNGLPLAAESLGGMLRRKHDIGDWNNILNSDIWELSESECKVIPALRLSYHYLPPHLKRCFVYC
consensus 351 *******.******.***************.**************************************

Rps1-k-5  420 SLYPQDYEFDKNELILLWMAEDLLKKPRRGRTLEEVGHEYFDDLVSRSFFQRSSTNRSSWPYGECFVMHD
Rps1-k-1  420 SLYPQDYEFDKNELILLWMAEDLLKKPRKGRTLEEVGHEYFDDLVSRSFFQRSSTNRSSWPYGECFVMHD
Rps1-k-3  420 SLYPQDYEFDKNELILLWMAEDLLKKPRKGRTLEEVGHEYFDDLVSRSFFQRSSTNRSSWPYGECFVMHD
Rps1-k-2  421 SLYPQDYEFEKNELILLWMAEDLLKKPRKGRTLEEVGHEYFDDLVSRSFFQRS--RTSSWPHRKCFVMHD
Rps1-k-4  421 SLYPQDYEFEKNELILLWMAEDLLKKPRKGRTLEEVGHEYFDDLVSRSFFQRS--RTSSWPHRKCFVMHD
consensus 421 *********.******************.***************************....****...******

Rps1-k-5  490 LMHDLAKSLGGDFYFRSEELGKETKINTKTRHLSFTKFNSSVLDNFDVVGRAKFLRTFLSIINFEAAPFN
Rps1-k-1  490 LMHDLAKSLGGDFYFRSEELGKETKINTKTRHLSFTKFNSSVLDNFDVVGRAKFLRTFLSIINFEAAPFN
Rps1-k-3  490 LMHDLAKSLGGDFYFRSEELGKETKINTKTRHLSFTKFNSSVLDNFDVVGRAKFLRTFLSIINFEAAPFN
Rps1-k-2  489 LMHDLATSLGGDFYFRSEELGKETKINTKTRHLSFAKFNSSVLDNFDVIGRAKFLRTFLSIINFEAAPFN
Rps1-k-4  489 LMHDLATSLGGDFYFRSEELGKETKINTKTRHLSFAKFNSSVLDNFDVIGRAKFLRTFLSIINFEAAPFN
consensus 491 ******.****************************.***********.*********************
```

-continued

```
Rps1-k-5    560  NEEAQCIIVSKLMYLRVLSFCDFQSLDSLPDSIGKLIHLRYLDLSHSSVETLPKSLCNLYNLQTLKLCSC
Rps1-k-1    560  NEEAQCIIVSKLMYLRVLSFCDEQSLDSLPDSIGKLIHLRYLDLSHSSVETLPKSLCNLYNLQTLKLCSC
Rps1-k-3    560  NEEAQCIIVSKLMYLRVLSFCDFQSLDSLPDSIGKLIHLRYLDLSHSSVETLPKSLCNLYNLQTLKLCSC
Rps1-k-2    559  NEEAQCIIMSKLMYLRVLSFCDFQSLDSLPDSIGKLIHLRYLDLSFSRIETLPKSLCNLYNLQTLKLCSC
Rps1-k-4    559  NEEAQCIIMSKLMYLRVLSFCDFQSLDSLPDSIGKLIHLRYLDLSFSRIETLPKSLCNLYNLQTLKLCSC
consensus   561  ********.***********************************.*.*********************

Rps1-k-5    630  RKLTKLPSDMCNLVNLRHLEIRETPIEEMPRGMSKLNHLQHLDFFVVGKHKENGIKELGGLSNLRGRLKI
Rps1-k-1    630  RKLTKLPSDMCNLVNLRHLEIRETPIEEMPRGMSKLNHLQHLDFFVVGKHKENGIKELGGLSNLRGRLKI
Rps1-k-3    630  RKLTKLPSDMCNLVNLRHLEIRETPIEEMPRGMSKLNHLQHLDFFVVGKHKENGIKELGGLSNLRGRLKI
Rps1-k-2    629  RKLTKLPSDMRNLVNLRHIGIAYTPIKEMPRGMGKLNHLQHLDFFVVGKHEENGIKELGGLSNLRGQLEI
Rps1-k-4    629  RKLTKLPSDMRNLVNLRHIGIAYTPIKEMPRGMGKLNHLQHLDFFVVGKHEENGIKELGGLSNLRGQLEI
consensus   631  **********.*******.*.***.******.******************.**************.*.*

Rps1-k-5    700  RNLENVSQSDEASEARMMDKKHINSLWLEWSRCNNNSTNFQLEIDVLCKLQPHENIESLRIKGYKGTRFP
Rps1-k-1    700  RNLENVSQSDEASEARMMDKKHINSLWLEWSRCNNNSTNFQLEIDVLCKLQPHFNIESLRIKGYKGTRFP
Rps1-k-3    700  RNLENVSQSDEASEARMMDKKHINSLWLEWSRCNNNSTNFQLEIDVLCKLQPHFNIESLRIKGYKGTRFP
Rps1-k-2    699  FKLENVSQSDEALEARMMDKKHINSIQLEWSGCNNNSTNFQLEIDVLCKLQPHENIESIEIKGYEGTRFP
Rps1-k-4    699  FKLENVSQSDEALEARMMDKKHINSIQLEWSGCNNNSTNFQLEIDVLCKLQPHFNIESIEIKGYEGTRFP
consensus   701  *.**********.*****************.****.********************.***.****.****

Rps1-k-5    770  DWMGNSSYCNMMSLKLRDCDNCSMLPSLGQLPSLKVLKIARLNRLKTIDAGFYKNEDCRSGTPFPSLESL
Rps1-k-1    770  DWMGNSSYCNMMSLKLRDCDNCSMLPSLGQLPSLKVLKIARLNRLKTIDAGFYKNEDCRSGTPFPSLESL
Rps1-k-3    770  DWMGNSSYCNMMSLKLRDCDNCSMLPSLGQLPSLKVLKIARLNRLKTIDAGFYKNEDCRSGTPFTSLESL
Rps1-k-2    769  DWMGNSSYCNMISLKLRDCHNCSMLPSLGQLPSLKDIGIARLNRLKTIDAGFYKNEICRSGISFPSLESL
Rps1-k-4    769  DWMGNSSYCNMISLKLRDCHNCSMLPSLGQLPSLKDIGIARLNRLKTIDAGFYKNEICRSGISFPSLESL
consensus   771  ***********.*******.**************.*.********************.*****.*****

Rps1-k-5    840  AIHQMPCWEVWSSFDSEAFPVLEILEIRDCPKLEGSLPNHLPALKTLTIRNCELLGSSLPTAPAIQSLEI
Rps1-k-1    840  AIHQMPCWEVWSSFDSEAFPVLEILEIRDCPKLEGSLPNHLPALKTLTIRNCELLGSSLPTAPAIQSLEI
Rps1-k-3    840  AIHQMPCWEVWSSFDSEAFPVLEILEIRDCPKLEGSLPNHLPALKTLTIRNCELLGSSLPTAPAIQSLEI
Rps1-k-2    839  SIDDMPCWEVWSSFDSEAFPVINSLEIRDCPKLEGSLPNHLPALTKLVIRNCELLVSSLPTAPAIQSLEI
Rps1-k-4    839  SIDDMPCWEVWSSFDSEAFPVINSLEIRDCPKLEGSLPNHLPALTKLVIRNCELLVSSLPTAPAIQSLE
consensus   841  .*..*****************..*********************...*******.************.

Rps1-k-5    910  RKSNKVALHAFPLLVETIKVEGSPMVESMMEAITNIQPTCLRSLTLRDCSSAVSFPGGRLPESLKSLYIS
Rps1-k-1    910  RKSNKVALHAFPLLVETIKVEGSPMVESMMEAITNIQPTCLRSLTLRDCSSAVSFPGGRLPESLKSLYIS
Rps1-k-3    910  RKSNKVALHAFPLLVETIKVEGSPMVESMMEAITNIQPTCLRSLTLRDCSSAVSFPGGRLPESLKSLYIS
Rps1-k-2    909  CKSNKVALHAFPLLVETIEVEGSPMVESWIEAITNIQPTCLRSLTLRDCSSAVSFPGGRLPESLDSISIK
Rps1-k-4    909  CKSNKVALHAFPLLVETIEVEGSPMVESWIEAITNIQPTCLRSLTLRDCSSAVSFPGGRLPESLKSISIK
consensus   911  .****************.********..*********************************..*..*.

Rps1-k-5    980  DLKKLEFPTQHKHELLETLSIESSCDSLTSLPLVTFPNLRDLEIRNCENMESLLVS--------------
Rps1-k-1    980  DLKKLEFPTQHKHELLETLSIESSCDSLTSLPLVTFPNLRDLEIRNCENMESLLVS--------------
Rps1-k-3    980  DLKKLEFPTQHKHELLETLSIESSCDSLTSLPLVTFPNLRDLEIRNCENMESLLVS--------------
Rps1-k-2    979  DLKKLEFPTQHKHELLETLSIESSCDSLTSLPLVTFPNLRYLSIEKCENMEYLLVSGAESFKSLCYLLIY
Rps1-k-4    979  DLKKLEFPTQHKHELLETLSIESSCDSLTSLPLVTFPNLRYLSIEKCENMEYLLVSGAESFKSLCYLLIY
consensus   981  ***************************************.*.*..****.****

Rps1-k-5   1036  -------FWREGLPAPNLITFQVWGSDKLKSLPDEMSTLLPKLERLLISNCPEIESFPKRGMPPNLRIVW
Rps1-k-1   1036  -------FWREGLPAPNLITFQVWGSDKLKSLPDEMSTLLPKLERLLISNCPEIESFPKRGMPPNLRIVW
Rps1-k-3   1036  -------FWREGLPAPNLITFQVWGSDKLKSLPDEMSTLLPKLERLLISNCPEIESFPKRGMPPNLRIVW
Rps1-k-2   1049  KCPNFVSFWREGLPAPNLITFSVWGSDKLKSLPDEMSTLLPKLEDITISNCPEIESFPKRGMPPNLRVE
Rps1-k-4   1049  KCPNFVSFWREGLPAPNLITFSVWGSDKLKSLPDEMSTLLPKLEDITISNCPEIESFPKRGMPPNLRVE
consensus  1051         ********************.*********************.*.*****************.*

Rps1-k-5   1099  IFNCEKLLSSLAWPSMGMLTHLYVGGRCDGIKSFPKEGLLPPSLTYLYLSGFSNLEMLDCTGLLHLTSLQ
Rps1-k-1   1099  IFNCEKLLSSLAWPSMGMLTHLYVGGRCDGIKSFPKEGLLPPSLTYLYLSGFSNLEMLDCTGLLHLTSLQ
Rps1-k-3   1099  IFNCEKLLSSLAWPSMGMLTHLYVGGRCDGIKSFPKEGLLPPSLTYLTLSGFSNLEMLDCTGLLHLTSLQ
Rps1-k-2   1119  IVNCEKLLSGLAWPSMGMLTHINVGGPCDGIKSFPKEGLLPPSLISLSLYDLSNLEMLDCTGLLHLTSLQ
Rps1-k-4   1119  IVNCEKLLSGLAWPSMGMLTHINVGGPCDGIKSFPKEGLLPPSLISLSLYDLSNLEMLDCTGLLHLTSLQ
consensus  1121  *.*******.***********.***.*****************..*.**..****************

Rps1-k-5   1169  QLTIDGCPLLENMVGERLPDSLIKLTIKSCPLLKKRCRKKHPQIWPKISHIPGIKVDNRWI  (SEQ ID NO:169)
Rps1-k-1   1169  QLTIDGCPLLENMVGERLPDSLIKLTIKSCPLLKKRCRKKHPQIWPKISHIPGIKVDNRWI  (SEQ ID NO:170)
Rps1-k-3   1169  QLTIDGCPLLENMVGERLPDSLIKLTIKSCPLLKKRCRKKHPQIWPKISHIPGIKVDNRWI  (SEQ ID NO:171)
Rps1-k-2   1189  QLQIFGCFKLENMAGESLEFSLIKLTMVECPLIEKRCFMKHPQIWPKVSHIPGIKVGNRWI  (SEQ ID NO:172)
Rps1-k-4   1189  QLQIFGCFKLENMAGESLEFSLIKLTMVECPLIEKRCFMKHPQIWPKVSHIPGIKVGNRWI  (SEQ ID NO:173)
consensus  1191  **.*.***.****.***.*.******...***.*** ********.********.****
```

Sequence of the Rps1-k region (sequences are from three BAC clones BAC18, 43 and 90 shown in FIG. 1 of the example 1)
>BAC18.FASTA.SCREEN.CONTIG1 (SEQ ID NO:174)

ATTTAGGTGACACTATAGAATACTCAAGCTTGCATAATTCATCAAGGTATCAATATCCACTCCCAAGGCACCACAAAAGCC

TTGATGGAAATTCATTTTGAGGCCCGAGACAAGTTCAAAGCCTCTCAAAATGCTTTTTATGGTAAGCACCTTAGAAATGGTT

GCTTCTCCTGTAAAGAGTGCGTCAAGCGTCATTTGCATATTGAAGCAAGTTTACTTCCTCTCTCCCACTACCCACTAAGAAA

TTAGAGAATTTGTTCCTTTCAAGTGCTTGCCTCGTGTTTTTATGAGACAATTCATCATCATAATATAATCTCAAAATAATATC

TATTCCTTATCAAAAAGGATACTACCAAGATACTTACAAAATTAACATTTAAATGTTGAAAATTGTCTCATATAAGATAAT

ATATATTAATAATGATTGCCAACAAATAAGTAGCATGAAGTACATTAAGAAGAAAAAAATCCCTTCTTTTTATTCAATTTTT

-continued

```
TTTCTCGTTCTAGCGACTAAATATTTTATATCAAAGCGTCTTGAATTAGACAACATTGTTTTCAAAGAAAATGAAGTTTGGG

AGAATATGTTGAGTTTAATTAGTGGAGGTACTTCACAAAAATTTTAGAAGGAAGGTAATTGTTTAGACATTTTTGTTAATGG

GAGCGAGGAAATCTTTGGAGGTGATGATCCCCTCTCAATTTCCGAATAAATAACCGAAGAACAATTAAAACTATAGAAAAA

TATCAAGATTCCTTAAGGAAGAATCCATAAATATTAAATGATCACTGAAATAAATCAATAAAAAAAAGTTGAAGGACGAA

AGTGAAACCAAGCCTTACATTAAAAGATAAAAATATTACTTTTACCTTCATGAATTTTATATAAATCTTATTTAGTAAATAA

AGTTTAATATTTTGTAAAAAAAAAATCATATAAAATGGATTCAACAATAATGTAAAAACAAAAAAATATTAGATATTCTTTA

AATAATAAGGTACTTCGGTTTGTAGAACACATTCTCAAGTTTAAAGAGCTTCAACCCGACCTTTGAAACAATTAACCTAGGG

TTAGCTCGATTTGGTTTAAGCCAGACTTGATTTAACTAAGAAATTCAAACCGAACTAATTGGTTTGGTTCCGATAAGCAAAA

CAATATAGCTTTAAATAGGGTTTGTCTAACTAAACCTAAGTAAAAATTTCACTGAAAAATTCAAACTTGCTTCTTATGATTTT

TAATGAAATTCAAATAACATTCTAGAAAATATGTAGCGTAAACATGGCAGGAGATAGGTAAGTACAGGAATATGTTGGGTC

GTTCACAGCAGGAACTTGAGCCACTGATACAACTATTGAGGAAGAGCAAAGAGGTTGTTTACAAGTGTTCAAAAATAGGGA

AATACAATTTTGTGGCTAAGAATTCTTACCGTGGAAAACTAAAATTAAAGATCTTGCAGACTCAATTGAGAGGTTTTTCAAT

ATTGAAATGCCAGCTCTTATTGCACGCGATCAACTTGAGATCTTGCTTAGGGTTAGTGAAATAGAATACTTCAATGATGAAA

AGTTTTCCGATTCGGTGATCGCGCCATTAGCTATAGCTGCTGCTGTTACTGTTGCTATAGTTATTAAATGTCTTCTGTTCTAA

TTTTTTCATGATTAATTAGGGATATTTGGATAGTCTGGATAAGGTTTTAGTTTCAAACTTTATTGTCTTTATTGTATATAAGCA

ACCGATTTGTCACGCCTATTATGTTTTTGCTTTTTTATTGTACTTTCGCATTTCTATTAAGCTAATTAAAGATGTTATATATAT

AGTTAAAAAATTCTTTCATATGTTTTTAAATGCATGTTTATCTTTAGAATTTTCTTTACTTCTTATACTCTACTATTTATGATA

ATATATAGTAATTCAATTTTATTTTGTATATTGCATGTAGGCTACCGTATTTTTTTTCCAACAAAATGATTTGTATTAAATGGT

ACCAAAATTACCTAAGATCCAAAAACATATACACCAGTGACAGTAGAAAGAAAGATAGCTAGCTTCGAACATGGACCATT

ACACCCAAAGTCATGGTTTTAAAATGTAGTCAGCAACCATAATTGCAGTCATAACGCTAATGTATTTTGACTCTGTAATCAC

ATCACAATTATAATTATGATCACATCAGTTTGTATTTTTCCATAATTATCCACAATGTAAGATTTTTAGGTTCGTTGCATGCA

ACGCAATCATAATTGCAATTTAAAATCATGTCTAAAGCCATGCAACATTGATGCGGCATCACTAACCAGCCCCCACCATCG

TGCACATAAACATCGGTTGCATTTGGGATGATCCCACTCGAAGAGCAGCTACCACCGAATCAAATTAACTTCACATTTCATT

CAAAATTGTCTCTTCATGAAACAAGCTCCAGGTGCCATATATCATTAAGTAAAACAATAATTAAAATTAGGGACTCTGGCTT

TTATTAATCCACGATCGTGCAAAGAATAATATATTCTGCGTAATTTTCTCAGCATTGAAAGAGCCATTAATTCCTTAGCATA

CACTCATTCCTAGCATTCCATACACACCAAAATTTCTGATGCCCACACCGCCCTCCATACATCTGCCTCCTTCTTTGAACTT

ACGAATACAGAATCTTGCCAAAAATGTGATTCTGGTCATTGTGGCAACACCACATTTACATGCAGCCAGCAGCCAAGAGTA

ACATTGCCTCCAAATTAGTACCAAGAATTTTATGACATGAGAAGAAACAGTGAGATACCGACTCATCTACCTCAAGGCAAA

AGGGACATAAGCACTCATGAGGATTATAAATGGTGTTTCTCCTTTTTAGATTATCCTTCGTTGGTAGTCAATCAATCAAGCA

TCACTCTCCAAATTAAGAAACACGCCTTAGGTTGTATATACCTTAGTGTAGTAGTATGAGAAAAAATATCCAAGTTAAATAG

AAAATTATTTTTATAAATATGAACACTTTTTTAAGGCAAAATGTAAAAAGAAAAGTTGCAATTTCTCCCCAATCTCTGCAA

GAGGTACATGTGTTACCGTATTACATACATAAAAAAATGGTTTCTCCTAAGTTAACTTTCAGTCCTAAAAAATGCCACTGTT

AACTTCTCTAACATCAATCACATTTGAAGTGGCTCCAAACACCAGCAAGAGAAGAAAGTTCATGGTTTTTTGCCTTATATAA

CAACCACTGCCATGAGATATGTTTTACGGCTGTCAAAATACCCCCTGGTTCACACTTTTTGCAACTAAAGGCTATCATATAA

AATATTTCTGTTGGCCGAAATCGGTTACGTTTCTTTTGATCGACCTTGGTCGAAGTTATTTTTTGATCAATGTCGGTTAGAAA

TTTTTTTTGTTAACCTTAGTCAATGATGTTTGTGATCGATATCAACCGATTATATTTTTTACCAACATCTTGTCAGGACTATTT

TTTGGTCAACGTCACCTTGGTTTTTTCGGTCAATGCGACAAAGCTTGTTACCAGGAACAACTTGAGGCACTTGCGGACTCGC

TTGTCAGGTTTTTCATCATTGACATGCAAGCTCAGATGGCAAGAGACCAGAAGGAGATCCTGCTTAAGGTTAGGAGAATAC

TTAGCGCTGTTAATAAATTTCCCTCCCACACAGTTGATGCATCTAACCCTGAAGAAAATGCAATTCTAGTATGGAAGCAACA

AATACAAGTTTGTCTTTGTCCTGCTATTCTGATCCTCTCTCTATCCAGATGTATATATGTTTGTTAGTGCATATATATATATAT
```

-continued

```
GCATCCATGTATATATGTTTGCATATACATACATATATGAATGTACGTAGATATATTCATATATATATATATATATATATA
TATATATATATATATATATATATACGTGCTTTGTGCATGTAACCATTTGCATTTAAAGAGTTTGTATCATTATCTTTGAAA
CATCTTTTTACGCTATTTTCAATAATACAAGAATTTTAGATCATTATCTTATTCGTTACTTCTCTTTAATTATATTTGTTAAG
TTAAAAAATATTAATGCTTTAAGATGAATTAAGACTCCTAATTGTAACCACATCAGCCATACTTTCCCGTGATAATTCATTT
CTGGTTTGGCAACATTTCCCACCTCAACTATCTGTGTCTCTTTTAGTAAATTCAGTAGGGATTGTAAGATTATGTGCTTAGTT
TGCTTTGTTTTTTAGTTTTATGATGTATAAAAAATTATAGATCAGTTAGTAGTTTGGTTTTAGGTTTTGTTCTGGTCTAGATC
GGATCATGTTCCGATCTTCTACATCTTTAGCTTTTACGCACTGTGTGCTTGAAGCTAAGGGGTTATCTTTTGGTTCAGATTGG
AATGTATTGGATTATGTTCCGATCTTCTATCACGCATCAAGCCCATAAAAGAGGCTTAGGTCAATTCACTTTCAAAGTTGGG
CCTTGCCAAGCGGGATCAAACGACCACCTTAAGGGGGATTGACGATAATCCGACTATTTCGGCAGAATAAGGGATTAACTG
ATTGTTTATGATATGCTGGTGATGCATCATGAAGGGACAACTAACATAAACTTAATAGCACGAAACATTTGCGGGATATGA
TGGAATATTTTGATGCAGCATAAAGACCCCAACTTGTAAAAATTGTGGGGGACTGAATGTGCTTCATTTTGAGGAGGCTTT
TTCCGGAACAGGTTTGTTATATTTTTATTGCATGTTATTTAGAATTAAAATCTATTATGTCAGTTGTGCATATAGCTTGCGTC
AAGTGAATCAATAAAGATTGAACTCGTTTCATATTATATTGATTTGATAGTTATATTTCTTAAGTGGGAAAATATTGAGATTC
TTAGAACATTTTTGTCAAAGAATCCATTTTAGGTTCTTGGATTATTTTTTGTGAGTCCCATGATGTTATATAGGATGCAAGAA
CTTCTATCATTTGTTATTCTAATAGTAGAATCCAATTTGGATTATTAGATTTTACTAGCACAAGAAAAAATAATATTTTTGAA
AAAATAGTAGTTCTTTTCCTAGAACCCAATCTCCATCTTAAAAAACTCTTAATAAGAATAATAGTAGATCTAGTGGATAGGG
TTCTTGAGTTCAAGAATCCCATTAAAGATGCTATTGGGCCTTTGACAAACTGTCCATGTTGTGCTACTCATTAACAAACCTG
TGCTTACATTTCATAGGCTCTGGTGAAAAAATAGATAAAAGTTATTTATATACAAATATTTCTAAACATTATTAAATGTATTA
CATAAAAACTATAGACCAATAATATCATTAAAAATGACGCATTTTAATATGTTAAGCAAATAAGATAATTTCAATCAATCTC
GAACAGAAAATATATAGAGAGAGATATCGAGTTTAATACTTATGTATTGATGATGTAAAATGATTTTACACTATTATAAATT
ATTGTTTGAATTACTTTAAAATAATTATTTTAAAAGTCAACAACTTATCACATAGTGAGTTGCAATTAGGTAATGGTTTAA
ATATATTTTTGGTCTCTGATAAATACTCATTTTTTGCATTTGGTCCCTAATAAATTTTTGCTTTGTGATAGGTCCCTAATATTT
AAAAAGCTTTGTTCGAAGTTCCTGCCGTTAGTCGAAATCCATTATCTTCATATGTGATCGATAACCGATCACGTAAGATTTT
TTATTTTTTATAGAAAAAAGTAAAAAAACGACATCATTAAGTCCCCGAATCCTCCAAACCACCCCCACCAGTCCCCAACC
AACTCCTCCACTAGCTCCACACCACCGCTATTGTGTCTCCAAAACCCCCAAACCTCCCTTGAAACCCCATGGCAGCAACA
CAACAATAATTCTAACCCATTTTCTTTTTTTTCTTCTCTTGAACCATGGCTCCCCATGGCAACAACAAATCTCCTTCTCTAAAA
AATCACTCATGGACCCCCCTTCCCAAAGAAAACCCTCCTCTTTGTTTTCATCATTTCCTTCTCTTCACCTACGACACACAA
GTGAGTTTGAGGGCCAAGTGTGAGAGAGAGACTGGGAGAGAAGTGAGGTTTGAGAGTTGAAGGAAGTTACTGGTGGTAGC
TGGCGCTGGCACGAGCAGTGGCACGACTGGCAACACCAGTGGTGGCCGATGGCTGGGTTGGTGGTGACCTTTAAGAAGGG
AGAACAAGAAGAGACAACCATGAAAGCAAGGGTTTGCAAAAAGAGCTCGCAACTATGAAAGGTCGACGACAAGTTCAGAC
ATCGCTATCCCACTCATTTTTTCGTGCTCTATGCAATGGACCGAGCGGAATCGCATTTTAGGGTAAGGTTTTGTTGACCTTCT
TCTACCCATGAAACTATTTTGATGTGTTCTCTTAGAAACCTTATCCATGTGAATTTCTTGAGTTGGGAGTTGGCTTGGTTTGA
TTTGAAAATGTAAAATTGATTGCAAGATCCTAAAAATCGTTGGTGAGGACCTCTTCACCTTGGATCTTCACGAGTGACGAAG
TCATAGTGACAAATCCATAAGAAAGGTATAGAAGAAACTATAATGGGTTGTGTGAAAACGTAGAGGAATGCTGAAGAATG
ATTTTTTGATGCCCAAGGGATTTTGACTATAGTTTCTTATCATTAGTCAAATCCGTTATTTGCTGAAGAATGATTCTTTTAT
GCCCAAGGGATTTTGACTATAGTTTCTTATCATTAATCCTAATCTCAGTCAGACAAAAATCACACATGACATGTCTGTGTGG
CTGGTTAACGATCGTGTGAGCAAATAACAGATTTTGACTAATGATAAGTATTTCAAACAAAACTTTTTAAATATTAGGAACC
TATTACAAAGCAAAAATTTATTAAAGATCAAATGCTATCCATTCCATTATGCCAACCTATGTTCCTTTTCCACTTCAGCTAGT
GCAACTTGTACGGCTGATTCTTTCTGCTGTCATACACAAGCATGTCTTGTTTCTGAGGCCCATTTGTCCTTTCTTTTTCTATTC
CCCACCCCCTCTTTTCCCTATCCTTTTATATACCTTCATTATGGACCTATCAAGTTCTAACCAGGAAAATTCCAAAAACATTT
```

-continued

```
CTAACCCAAATCTCCAAATTTACATGATGTCAAATAAGAAACAAACTAATAAATAAGAAAATGTGATTAAAAATAATATAT
AACACTACAGAGAAAAAAATCAGAAAATTAATTTTCCATGCATACTATAAAGAGATTACAAAGTAAAAAAATATATATTTT
CATGGAAGAAATGTTCATGTGAACACAATAATTACCTTGACTCCGTATAGTGATATTTTGTTGCATATCATTGCAGCAACTT
TTTCAAGAGAATGACTTGAGTATTTCCCACCTCTAGCTTCTTCTTCAATTTTATTTGCAGAACTGTTGGAATTTGAATCAGTG
GGAACTTGCAGCAAGCAAGCAACAGAAGCAAGGGGGTGCAATTAGAAAACAAGACCAAGAGAGCAATTACAAGACCCAC
TTACCTCAAGGATTAGGTGTGAAACAAGCAGGTGCATCATATCTGGAAGAATGATGCTGGTCGGGTAGGAATAGACAAACT
TAACAATTTCCTGATATTCTGTAGCACAAAAAGACAAATTCGATTATTGAGAAATCAGTATAAATAATACTATGTAATAACA
ACATCAATCAATGGAATATACAATTGTTCCTTCCCTTATTCTTCTCATTCTTCTCTCCGTGGAGGCCCTGGTCCTTGAAACC
AGCTTCTATCTTCTTCCCTATCAACAAGTATATAGCATATATAATTATGTATGATAATTTTAAGAAAATAAACAACACTAAT
ATAAAATATATAGAATAGTAAAATACAAAAAAAAAAAACAAGATCATATCTGCATTTCCAGAAGTATTTTATGGAATCTAG
ATTACCCAGGAAGTTAAATTAAAAACTTGAAAGAAGAAACAGAGAAAAAAGAAAATATTTTAAGATAAGTTGTAACCCGG
AATCAAAATAAAAGTTTATAAATAATTCAAGCACATATATATATTTTGGTGTCTTGATCTTATTGATGTATTTTGCAGACATT
GATATACTTTTATTACCCTATAGAGCTAGAACAAGATCAACTAATTGAAGGTTTAGTGACATTGTCACAAAGCAAAGAAAA
TGCCTGATTTATGAATATTCACTTTGAATCTACGTGAGTCAGAACAATTTCGTTCACCAAAATATGCCATTGCAGTTGAGGT
GGTCGGTCGTATGTGAAAGAGTCTGTTATGAGATGATGATCTTTTCATGCATTTCGGTATTGTCCTTTGCATTAACACTTACA
CAACATTCTCCAACTGAGTTAGCAGTTTGTCAGTAGTGAAACCCTCCTTGTCCAACAATTCCATATGAGGAACACTACCTGA
CAACATTGCTGATTTCAAAAGCCTTGAATTCTTGGATATCTCTTATAAACTCTTTTCCTCATCCTTGCCATTGGGAATTGGTA
AATTAGGGAGCTTGCAGAATCTCTCGTTGGCTGAAAATAACTTCTCCTGACTCTATTTCAGAGATGGCCTCCATCAAGTCCC
TCAACTTGACTTGCATGGGAATATGCTTCAAGGTGTACCCAACAGTAGTATGTTAGAAATTCTGAGGAACTCTATGCATTCT
GCACTCTACTTTTTCACGAAATGCCTCCATTTCAAACCAATAAAATGGTGATCAAATCTTCAATTCTCTCATTAAACCAAA
AAATATATGAACCCAACAGTAGTATGCCCTTAAAGGTGTACCATGCTTCAAAAAGCTTCATCAACACATGCGAAATTCTGA
GGAACTCTATGCATTCTGCACTCTACTTTTTCACGAAATGCCTCCATTTCAAACCAAATAAAATGGTGATCAAATCTTCAAT
ACTCTCACTATTACTTTCCTATATATCAATATTCTCACTTTCTAAGGTACAAACTATCAGGACACTTCCTTTTTTCTAACAAA
CCCATGATCACAAATTTCTTGAAAAATCTAATAAATTCAAAAGGTTCATGAGACTGCATTCATCCAATTCTAACAGTAAATA
ACAGGAATAAAGGCCCATGGTTCAGAAATATTCAATCAGCATAAGTTATTACAACAACAAACCTTGTATAGCTTCTTCCCA
GAACCAAATTAAAACCTTTACTCTGAATTTGAAGAACAACTAGCAACTGCGTATATCAGTATAGCTTTTGTTCCTTAACTGG
CCCTGTGCAATTTGAAGTTTAGCTTTTGTTCGCAACAAATCACCTTGATCCCATATATCGAAAACCTCCTTTCACTGAAAAC
CTCCTTCCAACAAAAGATCCAGAAGCACTGTGTCACACACTTGCACAGTCGCACTCCAACACCGAAAACCTCCTTTCACCG
TCGCACCCCACCGTAGCACTCTAGCACCGACTGCATCACAGCAAGAAGCCAAGAAGCATGAACCAAACAATTTTGCACTTT
GCATAACTCGAACAAGGTAGACAAAGTCTACTCAAATAAGTAGCTACAACACGACACCGTTTCGGGTTTTCGTAAATCCAC
ATACTCGTAGCAGACTCGCGAGTCTACCCAACTCGCCCAAGTTTGCGCTAAATCAGATGAGTCTATTCCGTTTTCAATTCT
GCTTTCGATTTAACTCGCTGAAGCTTAGTGGAATCGTAAAATCATACAATTCTACGATTTAAAACATGAGTTTAACAACCTT
GGATGATTCAAGTAAAATAATCCTACTAGAGATCTTATGTGCAAATGCAACGAAACACACATAAAAGTACATATTAAAGAT
TTAACAATATCATAAATTTAAATAATTTTAAATATGATAGAGATCACAAATATCATTGATGGGATACAATCTTACTCAATGT
CATTATGGACGTCAATGTTCCTACCCTGAGTAGTTAACACAAATGCAAACCAAAAATTCAATAATAATTATTTTTATTTTTA
AATTCTATAAAATCATTTTAAGTAAATATATAATAGATATATTAAAATTAATATATTAGTCCCCGTTGATCCTTGTGTATGAA
ATAAATTGGGTTGGGAGGGAATAGTCAAATTATGTGCACTCAGAATTCTTGAGGAAGATTAGTCACTTAGTATTTTTATTT
TAAAAAAAATTAAATTATTTACTAAGAAATAGCATAAATTAAATTAGTTTTATTCTCTTTGGGATAATGACTAAAAATAATT
CTTCTTATGGGCCAACCATTATAGGAAAAAAAAAACTCTTTCGCGAGTAATTAAAACAATTGCATATTAAAGACTCAACAA
TTTATTTTTAATTCGAAATTTTATAAAATTAGTTTTAATTAGAAATCATATAAAATAAAATTAAATAATCTTATAAATAAATA
```

-continued

```
TTTTATTCATTAATATTTATATTATAAGGTTGAAATTTTTATACTATAAATAAATTTAATTTTAATTAGTTAACAAATTTATTA
CAAAATAATGTTTTGACTCTATGTTAAAAATTAATTAATTAAATATATTTTTATTAAAACTAATTTTAAATCATTTCGTCAAT
AATCTCATAAACTTAATTAGTTTAAATATTTTTGTAGTAGAAATCATAAATATCATTCATAAGAAAAAATCCTACTCGAAAT
TGGATTATTATATGCAACAAAACTATTTCTTCCAATATTTTATAAAACTACATACCAAAAGACTTAATAATATCATATATTAT
AATAATTTTAGTTATGCTAGAGATTACAAATATGATTAGTGACAAGAAAATCTTGCCAAAGACTATTATAGACCACAATATT
TTTTTTATCCAAGTAGTTAACACAACTACACATAAAAAAAACTGAAATAGTATTTTTTTTTTACTTTCAAATCTTATAATAT
TATTTTTATTTGGAAATCATTCTTACATAATTATATAACATTTTATTAAATATATTTTTATCACAATATAATTTTAAATTACTT
ACTCAATAAAATCATAAATTATATTAATTTTAATTTTTACATAATATGTAGTAATAAAAATATTAAAATCAATTTATAAAATG
TATTTTTATTACAAAATAGTTTTAGGTTACTTACTGAATATGCTCTTTCTTCAAGTATTTCACACAAATTCATATCAAAAACT
TAATAATATCATAAATTAAAATCATTTTAATCATGACAGGGATCTTAATAATCATTGATGAGAAATAATCCTACTCAAAATT
ATTACAAATGACACAGTTCTTTCGCCTAGTAGTTAACACAATTGTATATCAAAGAGTAAAAATAATATTTTTTTTTAATTTG
AAAACCCATTTTTACTTTATAATCACTTCTACATAATATATAATAACTACTAAAATTTAATTATTAAATATAATTTTTAATAC
AATACTTTTAAAATACTTACTCAATAATACATTTAATTAATATATATTTTTATGATAGAGACCAAAAATATCATTCATGAAA
AACAATCACGTGTTTAACGTCATTACAGGCCAATTATTATGGGTGACAAAGCTTTTTCTTTAAGAATATTTAACATAACAAC
ATATTAAAGAATCCACGATATCTTTTTAAAAATTTGAAATCCTATAAAATCAATTTTACTTAGAAACCGTATAAAATAATTT
TATGAATGAAATATTTTTTGAATAATTTATGTTATGTAGTTGAAATTTTTATACTATTAATTAATTTAAATCTAATTAGGTAAT
ATGTTTATTACAAAATATTATTTTGTCTCTTTTTTAATAACTTCATATATGGAAATTTTATTAACTAATATTTATAAAATAAG
TTTAAATATCATTTTTTCATAATTATATAAGAAATATTTAATATTAATTTATTAAATATATTTTTATAACAAAATATTAAATA
CTGAATAATATCACAAATTAAATTAATTTTAATAGTGTTGATTTTTTACATAAATACATAATAAATATATTAAAATAGAATT
TATGAAGATAAAACAGGTAAAAATATGAATAATAGTTTCAATTTTCAAATAATAGAAGACAATGATTTAAATAGCCTAAAA
ATTAGGATTTTGATTTTTTTTTGCTTGAATATTCTAATCCTTTTTTCATGTTTATTGAATATAAATACTAAATAGCTAATTAT
CTTTTTTAAGCAAGTGTATTTTGAATATGCGTAAAAAAGGAGAGCGATCTGCGTAAATGTATGGGTATCTTGCTAGTTATTA
ACTTATTGTAAATGGAGATATAATATTGATGGGATGGTTAAAAAATTATGAAAGAAAAGAAAATTTGTGACTTTACTTCCTT
ATACTAACAAAAACTCACAAAATAACGATTAAAATTTATCAATTAAAAAAACTTATTATAAATTCAACTAGAAAACAACTT
TAATTTCAGTGATATTCGTAAATGGCAGACAACATTTCATCACTTCACTTTAATAAAGGATGCAAACTTGCAGTAGTAAGGG
AAAAATCAAGCTTATTAAGACATAATTGAATAATTGAAGTTTATTTCAAAATTAGTTAATTTAATTATGGTAAATGTTAACT
AGTGTTTTTAAGGTATTAATTGGTTATAAAGAACTAAAATAATAATTTTTTATTGAAATATATAAAATAGTATTATTTATGA
TTTTTTTTACATACTCTTATGATTTTCATAATAATATTTTTTATTTTAATTTATTAACTAATGCCTTAGGGCACTGATTAGC
AACATCCTTTAGGTTTTAGCAACCATTAATTGATTTTTATTTTTTAGCCATTGAATTTTTCATTTTAAAATTATTATAAAATAT
TAATTTATTAAATCAGAAACTAAAAAGAACAATTTATCAAAATTCAGAGATTAAAAAAACTTTTATAATTTTAGTAACTAAA
AAAATCTCAGCCCAACAATAAAGAAAAATAAATATAAACAATTTAATAGTAAATTTAATAATTTTTTGCGGTGATCAAAGA
TATGGTTAAAATGGAAGTTTGTTGTTGACTTAATACATGCCAACAAGGTACTATGATGGGTGACATGGCATGTGAAAAATTG
AACTCTCACGTCCTTGTTATGTCAATCTTAACATCATATCACCAGTCTTGTGTTAGCAAAAATTTCTTAAATATTTATAAGAA
AATTTATAGAAGAATGAAAATCACCCAATTGTTTTGGGATCTATGCAAGCAAAAGTATACAAACAAAACAACATATACAGA
AAAGTACATACACACCATTCTAGAGAGGGTGTGCTTATTTAATTGCCAACAAAACAACATATTATAAATTGAGCATGCTTAT
TTCAAGAGTAATTAAATTAACTACCAATTTGATATCTAGAGTATTACTCTTTCTTATAAATAGTCCTTAAAATAACAAAATC
ATATATAAGTAATTTCTAAAGTGTTAAATATCCATTAATGCATATATACATTGAAATATTTTATCAATGTATAAGGATTAATT
TGAAGAATGTTTCAATACTTGAAAGAATTAATTTATATTTTATTTTAGTGACTATTTAAGAGATGAAATTGATAATTTACGCT
GGTCTTATTTGGATTCCTCGAACTTCAATGCTGCTCTTGGGGTTCTCATCAGTGACTATTATAGAACTCACCCAATCTTACCT
CCATCCACCCATCGTTTCTCTGCACAGAATGTCCATGCAAGAGTGGGGATGTCACGGAACGTTAAGGGACACCTCAACAGG
```

-continued

```
CTTGTTCCTGAACCCGGTGGCATTATTCCTTAGCCTAAACACTAAGTATGCCTCCTATACCGGAACTTGTTTCTAATGATTAT
TTTTTAAAAAAAATAACAAATTAACATATTTAATATATTAAGAATACAATGTATTTGAAATAAATTAATTTCAATTCTATGGT
ACCAAAAGTAACTGGATTTGAAACATGTTTCAATTGTTAATATTTTGGTACAAGGAAAATTTCCGAGATAGCCAAAACTGTC
AATTGAAACCTTGAGATACCATAAATATGACCCAACATAATCATATATCATATATATACTCCTAGGAAAATATTTTTTACAT
GAAATAAAGTCTCCTCATCCTTGCCATATGAGGAACACTACCTGACAACATTGCTGATTTCAAAAGCCTTGAATTCTTCTTGGAT
ATCTCTTATAAACTCTTTTCCTCATCCTTGCCATTGGGAATTGGTAAATTAGGGAGCTTGCAGAATCTCTCGTTGGCTGAAA
ATAACTTCTCCTAACTCTATTTCAGAAATGGCCTCCATCAAGTCCCTCAACTTGACTTGCATGGGAATATGCTTCAAGGCAA
TTTGGATTAATAAATTACTCTAGAACCTGAAAGGTTAGTTAATTCACAATTTTTTTTAAAAATTATTATTACCAAAATTTTA
TGATATCATTGATGTTTATATTTTTATTTATTATATATATATATATATATATATATATATATATATATAAAAATTACATTACT
TAAAAATTATTTATGAAAAGTAAATTTAATTAAATATAATATTCAGTAACTATTCAAGTATATATAAATATAATTATCAACTT
GTATAACAGAGATATACTTTTAGCTTCTTTTTAGAAAATATTACTATTAGCTTTAAAATGATTTATATATATGTGATATTTTA
AATTACATTTTTTGGTAAAATATTTTAAATTACTTTGTATCACAGTTATTATATATCTTTAATATTTTTTTTTTGAAAAAATAG
AATTAAAATTAAAACTTAAGATCGAGATCAATCCAAACTTATTAAATCATATTTAAATTTTAAACTACATCAATTGAACAAT
GAATTAAGAAAACCAAAAATTGTATAAGATGATATTTCTCTTTTTCAAAACCAATTTAATCTACTCTATAAACTCCTCTTAA
TCGGACAACTATTAGAAAAGTGAAAAGGAAAATATAAAAAATTAAAAAAGTAAATAATTCGACTTTGTAGAAGTCATAACC
ACATTCTTTATCATCCTTCTCTTCTCTATCCCCTCATTATTGCACCTGACACATTTGTTTAACACGTTGTCATATTGTCTGATC
AATAGGAATATGATATATCGCCTCTTTATTTTCTAATCATGTAATTGCACTGATTTATTTTCTGTTCTTATCATGATTGGTTTC
ACATTATTATTATGTCATGCACTTCATCATGATGTGTTGCACTAATATTAATGATCGTTCTACAAATCTTTGTTGTACCCCTT
AAATTTCATTAGCTTCTGTCTTTTTTTCTTATGGAAATTAATTAATTAACATTGATTTTGAAGTGCTTGTTAATTACAGGCA
CCATGGAGGAAAGAGTGGGGCTTTTGTTTCTGATTTTTTCATGCAAGAGAGGTAACAATTGTTAGATTGGCCTTTTTCTTATC
TTTTTGCTTTTAAATTTAATTATCGTGCTAAGTTAGATGGATATAACGTAGTTACAACCTCACACTAAATTTACTGTACCATA
ATAAAGTTTACCTGGTTCTTGTAGTAAAAATATAAATAGTGATGAACCACATACCTTCTAAAACCATACCCATACCTGTTTC
ATATACCTAGTAACTTAGAGATAGAATGCAAGGCTTGCATTATTCACTCTCCTATATATTTATTTACCAAACTTTGGTGGAA
ATTTTAAGGAGTGACAGGTTCATATTAGCTTTTAACCATCAATGGAAAACTAGAAAAAAGAAAAAGCTGGCACTAACAACC
AGTTATTTGTCAATAGGAAAGGAAGCTTGGGCCCAATTGAAGGATGTTGTGGAAAATTAGTGTCTCTTTGATTTCAGAAGCT
TTACTTTTTTTTTTTTCCAATACTTACAAAAATATCATCATATTTTTTACCTCATGTCATGATTTGAAGAATGTGTTTTGC
TACAAAGTACTGATACTTTAATTTGCTTCATGCATCTATATCCGATACCAATATATTGATATATTTCACTGGTACATATATGT
AAAGTGACCAATTCTTTTAAAAAAAAAATTATGATAATCAAATATAGTGACATGTAACATAGAAGTAAATATAATATAGAAA
TATAAAAAGTATTGTTTCTTGATGAACCAAATATGAAAATTGTTTTGTTTATAGATAATTTCAAGAAAGAAATGAGATTGAT
CATTGATAGTACCATTCTTATTTGTGAACAATAGGAAAAAATGATCTACAATTTTTTGATTTTGTTTTTAGCAATGTCTAAGA
AGTATGTATGTTCTTCAATTTACCGAATTGCAATTGTATATTTATTATGCTTTTATCAATTCTTACGTATCTACATATCTATCA
TATTTTTAGAATAATCATACCACTATTAATTTATAGGACAGGAGATAAGAGATAAGCTGAAATCATCCAATCCTTCTAAAGT
TCACTTGGTACACCTTTTCATCCTTCACATTGTACCTAACAAAAAACCTCACAAATAAAAATTTAGCTATTGAGAAAGTGTC
AATTTGACGTCAATTAAATTAAAAGTTACATTTAGCACTAGTTCAAATTTGAACTTAGATTCATGGGTAGGTACAGTTTCTC
CGGGCCAATCAACCATATCTGAAAAACAAAAATAAGTTTCCCACGGTCATTTTCACTCTGGCCTCAATAATCTTAAGGAGA
AATTAAGTTAGAATATAACAATACTGATGTGTAACATTTTTCCGGAGAATCATTATATTTAAGTATTTATCAATGTTGTTACT
TAGTACCTGTATCGTTACTTCTTCGAAACATATATACAAGGTCAATTTCCACGTTGCCTTTGATGATTTGTTGATTCTCTGTA
GATTCAGTAACATATATACAAGGTCAATTTCCATTTCAGAATGAATTGGATTTAGTAAAACGTAAAAGGAGAAAGACATGA
AATGAAACATATCCTTGACAGAACTAGTTTTCTAGTTGGTTAGACTTAGAAGATACCTGTTGGTCCTCCTTGGTGGCTAAAT
CCATCTATTGTCAACCTTAATGCCAGGGATGTGGGAAATTTTAGGCCAAATTTGAGGGTGCTTCTTCCGGCATCGTTTTTTC
```

-continued

```
AGCAAAGGACAACTCTTTATGGTTAATTTTATTAGAGAGTCAGGAAGCCTTTCTCCCACCATATTTTCCAGCAAAGGACATC
CGTCTATGGTTAATTGTTGCAGGGATGTGAGATGGAGAAGCCCCGTGCAGTCCAACATCTCCAGATTTGAGAATCCACTTA
GATACAGATACGTAAGGGAGGGAGGCAGCAAACCCTCCTTAGGGAAGGACTTGATGCCATCACATCGACCCCCAACATAG
AGATGAGTAAGCATGCCCATGGATGGCCATGCTAGGCTGCTCAGTAGTTTCTCACAATTGAAAATCCAAACTATTCTCAGG
TTAGGTGGCATACCCCGTTTTGGAAACGACTCAATTTCTGGGCAGTTGGATATGAGGAGACGTTCTAACTTTGGGAGAAGA
GTACTCATCTCATCAGGCAACGACTTCAACTTGTCAGAGCCCCACACTTGGAAAGTAATCAAGTTGGGCGCAGGCAATCCT
TCTCTCCAGAATGATACCAAAAGAGATTCCATATTTTCACAGTTTCTGATTTCAAGATCTCTGAGATTTGGAAAGGTAACCA
ATGGAAGAGATGTGAGTGAATCACAACTGCTTTCTATTGACAGTGTTTCCAGTAACTCATGTTTGTGTTGCGTCGGGAATTC
CAGTTTTTTAAGATCCGAGATATACAGACTCTTCAGTGATTCAGGTAAACGACCACCCGGAAATGACACGGCTGACGAGCA
ATCCCTTAATGTTAAAGACCGGAGACAAGTTGGTTGGATGTTTGTGATGGCCTCCATCATGGACTCCACCATTGGGCTTCCT
TCTACTTTTATAGTTTCTACCAAGAGAGGAAACGCATGCAGTGCTACTTTATTGCTTTTACGTATCTCCAAACTTTGAATGGC
GGGAGCCGTTGGGAGAGAAGAGCCAAGCAGCTCACAATTTCTAATTGTAAGTGTTTTCAGAGCAGGAAGGTGATTCGGCAA
ACTTCCCTCTAGTTTGGGGCAGTCACGTATTTCAAGAATTTCAAGCACAGGAAAAGCTTCTGAATCGAAGGAACTCCACAC
CTCCCAACAAGGCATTTGATGAATGGCCAGAGATTCAAGGGAGGGAAAGGGCGTCCCAGAACGACAATCTTCGTTCTTGTA
AAAACCTGCATCAATAGTCTTCAGCCTATTCAATCGTGCAATCTTAAGGACCTTGAGAGAAGGTAGTTGTCCAAGTGAAGG
AAGCATACTACAGTTGTCACAATCACGCAATTTTAGACTCATCATATTGCAGTAGGAAGAATTTCCCATCCAATCTGGAAAT
CTGGTTCCTTTATAGCCTTTTATTCTCAACGATTCAATGTTAAAGTGAGGCTGTAACTTGCAAAGCACATCTATTTCTAGTTG
GAAGTTGGTACTGTTGTTATTACATCTAGACCATTCCAACCATAAACTATTAATGTGTTTTTTATCCATCATCCTTGCCTCCG
ACGCTTCATCACTTTGGGAAACATTCTCCAAGTTCCTAATTTTAAGTCGACCACGAAGATTTGAAAGTCCTCCCAATTCTTT
GATCCCATTCTCTTTGTGCTTGCCCACAACAAAGAAATCCAGATGTTGTAGATGATTTAATTTACTCATTCCTCTCGGCATCT
CTTCTATAGGAGTTTCACGTATCTCAAGATGACGCAAGTTAACAAGATTGCACATGTCACTAGGCAACTTAGTCAGCTTTCT
GCAACTACACAACTTCAAAGTTTGCAGATTGTATAAAATTACACAATGACTTTGGCAGTGTTTCTACACTTGAATGAGAAGA
TCTAAATAGCGCAGATGGATCAATTTACCTATTGAATCAGGCAAAGAATCCAAACTTTGGAAGTCACAAAATGATAAAACT
CTCAAGTACATAAGCTTCGACACAATGATACATTGTGCCTCCTCGTTGTTGAATGGAGCAGCTTCAAAATTGATAATGGACA
AGAAAGTTCTCAGAAATTTTGCTCTACCAACAACATCAAAGTTGTCCAAGACTGAAGAATTGAATTTGGTAAATGACAAAT
GACGAGTCTTAGTATTGATCTTTGTTTCTTTCCCAAGTTCTTCTGATCTAAAATAAAAATCTCCACCGAGTGATTTGGCTAGA
TCATGCATGAGGTCATGCATCACAAAACATTCACCATAAGGCCAACTACTTCTATTTGTACTTGAACGTTGGAAAAATGATC
TCGAAACCAAATCATCAAAATACTCATGACCAACCTCTTCTAAAGTCCTACCTTTCCTTGGTTTCTTCAAAAGATCTTCAGC
CATCCACAACAAGATTAATTCATTTTTATCAAATTCGTAATCTTGGGGATACAACGAACAATAAACAAAGCACCGTTTTAAA
TGTGGAGGGAGATAATGATAACTAAGTCTCAGTGCTGGAATAACTTTACACTCACTTTCAGAAAGTTCCCAAATGTCACTAT
TCAGAATATTATACCAATCCCCAATGTCATGCTTTCTTCTCAACATGCCTCCAAGGGACTGTGCTGCTAAAGGCAGTCCATC
GCACTTTTTAACAATCTCCTTTCCAATTTTTTCTAGTGTTGTGTTCTCGTTCGATTCCAAGGAAAGACACGCATGGTTCGCAA
ACACTGACCAACAATCTTCATTCGACAATTGGTTTAGATGATAGGTTTGAACCGTTTGGACTACGGAGGCTGTCTTTTCACT
GCGGGTTGTTAGAAGAATTTTACTTCTCCTAATAATCCCACATTGAAATGGTTTCTTAAGAAGACTCCAATCAACATAATCC
TCTGTCCAAACATCATCCAAAACAATTAGGAATTTTTTATCTTTCAGCTTGTCCATCAATTCAAGATGAAGTAGATTCAGAT
CATTCAATTTACAAGGATTTCCAGTAACCGCCTGTATTATAGTTTTTGTGACCTTCAGAACATCAAATTCTTGAGAAACACA
AACCCATGCCTTAAAATCAAAATCAAATTTCTCTTTCAAATTCTCATCATTGTACACCAATTGGGCCAAGTAGTTTTTCCA
ACCCCACCCATGCCCACAATAGGAACCACAGACACTTCACTACCGTCACTGTTATCCTCCGACAACAACTTGATTATGGCC
TCCCTATCTTTCTCCCTACCATATATATGAGATCCATCTTCCAGAGATGTTGATGGAGCTTTCCATGACAAGTTCTCCACTGC
ACTCTCTTTCAAATCAAGACTCTCCTTGAGTTTTAAATGAGACTCTAGGGTGACAACTATGTCCTCCAACTTACTAACGATC
```

-continued

```
TTCCGATCGGAAAAGCGAGAAAACAAGTTTCTTACCTTGTTTTGGGTGGCAGCTTTGGTGAAAACATGGTCGAGTAAGTCAT
CGGCTTCATAGACAGCATCTTTGAGAGCATTGAGCCAGTGTTTGACATTGGTGTTTGTGATCTGTTTCTTCTCGGCATCATCA
AGCACAGCTCCAACCACTCTGAGAGTGGTCTCCAACTTTCGAAGCAACTTCTTGCTAAGCTTCTTTCCAAGGATCAAGTCAA
CAAAGTCAGGTGAAGCCAGCCTGTCGAAAAGCACATCAAGGAAAGCAGAGAGAAAGGCACCACCGACCAGTGCTGCAGC
CATTATCTCAAGAACAAAAGATGATCAGAGTAGAAAGACAAAGGCAAGGGAATTGGTTGCTATGAACTGATGTGATGAGA
TTTGGCTTAAGTCAACTCTCTTCACCTTCACTCGTTCTGCTGTGCAAGACAAAAGTATGGTCTTTTTTATTTTTATTATTTGTA
TTATTATGGTGGTGGGTGACTTATCACGTTGGGAGTCTCTTTACTTTTGATCCTCACATATGTTACTTTCTTGATATTTCTATT
TTGAATTTAGCTCCTCTAAACTAAAGACTCAAGAGATTTAAAGAGTGATGATATAAACAACTAACACATGATGAGATATGT
TATTGTATAAAGATCTGAATCATGATTTTATAAAAAGTTAAAATAATTGATAGTAATTTATGTTTTTTAATCAAGTGGTAAAA
GATTTAAATCTTTATTAATTCTTATATATAGAATAAATTTTGTTAGGAGGAAAATAAAAAAATGAGATTAAAAAATTATTAA
CACAATAAAAATGTTGAACAAATTAAAAGAGAAAGAATTAAAGAAAAGACACATGCTAATTGATCCCTAAAAACAATAAT
ATATATTAATGAAGTCAAGATTTGAATATCCTTATATGTAGATTAAAGATGTGTGCAAAAAGAAAAGTGTGTGATTTTTAT
TAAATAAAATCAATAAATACTAATAAAATAAAAAATATTGTGAAGATGTTATAATAATAATAATAATATAAAGAGAGT
GATTAAAGTAATTCTTTTGAAATGATGGCATGAAAAATTATTATTCAATTCAACTCTTTTTTTTATGTTATATATCTATTGTAA
TTATTTGATAAATACTTCCATAAAATTTCTTGGTTGGTGATTATCCTTTGAATCTTATTTATATAAAATTTTATTATTAATAT
ATTCAGTGAGATCATCTCAAACAACAATAGTAAAATGAGAGATAAAGAAAATTTAAGTTCAGCAAATGAAAATATTTTACT
ATATGTAAAAAATATTTTTTCTCCTATCATATTTAATAAATATAATTTTATTTTAAATCAACAGGTATAAATTTTTATCAATA
GTTAAAATAGATTTAAGTGAACTTCCTAGAAAAACTTTTTTATTTGTTTGTTTAAGTGTTGAAGATATTTATCCTCTAACTTA
TTTTTTCTCATTACAATTATTTTTTTCTTTTTACTACCAAACAAAACCTTACAGGATTTTTTACTCCACTACACTTGCTCTCT
CCTCATTTTTTCCAAAATACACCTGCCTCAAAATTGTTTCCTAAACAACACTCCTTTTTAGCTTGCAGAGAGAAGTCGGGGT
TAGGGAACCCAACTTCTCTTTGCTCCTATTATTTTTTAATTTAAAAAAAATTATTAAATTCTTTTTTTATATTTTTTAAAAAT
AATTTACTTGTTTTTTAAATATTATTTTCAGATAAAAAAATAACTAAATTTTTTATTATTATTATTTTGTTTTTTAAATAATGA
GAATATTTTTGTTTAATTATTTATTTATAGTTTGAAAATAATTAATTAATAATCTTAAAATAAATTTAAAAAACAAAGTGAT
TAAAAAAATAGATTGATTAAAAAACCCAATAAATATATGATTATCACATCTTAATTATATTATATTAAGAAATTAAAATACTC
AAATAACATAAAATATTAAAAATTAAAGAGACAAACATCATAAATGGAACATATAATAAAGCAAAAATAACAGAATGGAC
TAACAATAATAATTGAAACATGAAATAATGAAAGCATAAACAACTAACACATGAATCATTCCCATTATCAACCTCATTTG
ATTATTAATCCTTGGGAAGGAGACATGTTACAACCTACCATAGTTTTTTACCTAACAACTATGGTATTCATTCTAGAAAAA
AAAATGTGAAAATTTTCGATAATAAAAACATAACAGAAAAAATTATTTCAATATATCTTCATCTTCAGTTTTTTCTTAGATA
AATATTATTGTTCATGTATTTTATTTATGATGTAATGTATTCCAGTATAAATAAATTGTTAAAAATATATATATAATTAGTTTT
TATACATTTTTAAAAAAATACTATAAACAAAAAATTCATTTATTAATTTAACTTGTTAAATAAAAATTTATTTTTTAAAAAAA
GAAAAATTAATTCCTTTATTTTTTTAAATATTATTTTTACATTAAAAATAAATTAATTTTTTAATATTACTGTTTTACTAAATA
TATTTTAATATAAAAATAATATTTAAAAAAATAAAGGAATTAATTTTTCTTTAAAAAATAAAAAAAAGTTAAATATTATTAT
TATGGTGGTGCGTGACTTATCAGGTTGGCCTAGATGCTAATATAGTAAAGAATATTGTGAAAAAGTTGTAATAAGAAGAAG
AAGAAGAAGGCGGATACAAGCTAGATCTTACATAATGGTAATTAGGAAAAACAAAACCAGAGACCCCCTCTGATAGGGAA
GAGTGATAGCATAGCATACAAAGGGATGTATTCAGAAAAAATAGATGTGAATCAAGCATAGCAACTACAGGGGTGTCTAT
AGCAAAGAAGGGTGTAAATCAAGTAGAAAAGGAGGTGCAAGCAGCAGTTAATACCAAAAGAAAGATCTCGAAGCCTGCTT
ACCTTAAGGACTACGTGTGATCCTAAGGAATGATGCTGAATGATCTGTGCTAGAAGCAAGGGAGACAAGAATAACGATTTC
TGATTTCCTCTAGCACAAAAGGACAAAATCTGTTATGTAGAAATCAGTATAAATACAATAGCATGTAATAAGCAGCACGAT
ATGAATGAAATTAGCAAATTACTCTCATCTCTGCTCTTCTTCTTCCTCTGGAGGTTCTGGTGCCTCGAAGCCAGCTCTTAATT
TCCTGCATTTATGTTCAGTTCGTAACAATTGGTGCTCTCGTTTGTCCTCATGGCCTCACGCAACCTCGACAAGGCCCTTGTTC
```

-continued

```
GTCTTGACAATACCATGCACTCTATGACCCTCAATATGGACAAGCTTCGCAACCGCCTTGCTCCTGTGCCTTCCTCCACCAC
GCCCAACCCCACACCAGTCCCTTGCCACTCCACCTCTGTTCCTGCACAAATCCGATATGCCTCATCACCGTATGAGGATCCT
GTCGATGCCTGTTCAAACTCACTCAGACGGGTTCAGTGCTAACATACCTGAAGGAGTTCGAAGACTTGGCTAATAGAATT
ATCGGCTTGTCGGCCCCCTTCCTGTTGCCTTGCTTCATCTCGGGTTTGACGTCGGAGATCCGCCGCACAGTCCAGGTCCACC
AGCCTATGACTGTGGACCAGGCCGCCAGCCTTGCGAAGATCCAGGAGCAGAAGCTATCGGACCTTCGTCTGCCTCCACCGC
GGCCGCGACCCCACCGTTGGTAGCTCCACCACCAGCCCCTTTGGTTCCCCCTCGTATCACGCCTTTGCCCCCTTTGCTGCCT
TCCCCGCCATAGGCTCCGACCGTCAGGCGTCTCACCCCGGAGGAGTTAGCCTCGCGCCATAAGCACGGGCTATGCTTCACA
TTCGATGAGAAGTTCCATAGAGGCCATTGATGTGCCTCTAGGGTTCATCTCTTAATCGCAAAGGATCAGGAACCTGTAGACT
AGGGGTGGGTAAATGGGCCCAGGTCCATGGACTGGCCCGTGGCGCCCGCGATCCGCTCGAGTTACGAACCAATTTTTTAAA
ACAGTTCATGGTTATGTCATATTTTTTGGTCCGCCCCGCTTAACCCGCGGACTATGCGGGTTTGGCCGCGGGGTCCACGGGT
TGCCCGCAACCCGCATTTGGTTTGATTTGTGTGACCCTGACCCAATTATATTAGGTTTGATTTTCTCTTTTTCACTTTAAACTT
TTCTTTTAAAATAACAAATGAAGAAATATATTATATAAGATAAAGATTTAAAGGTAAAAATAAAAGATTTAAAGGTAAAAA
TAAAAGATTTAAATTAAAAGATGGTAAAGATAAAAAAGATAAGATAAGAAAAATAAAAGATAACAGAAATAAAAGATTAA
GATAAAAAAATATAAGTGATAACATGCTAAAAATCTTCCTTTTTGATATTTTCTCGATCTTTTTTTCTTTAATCTATCATTTT
CATATTTGCAAGTCATAAATAATAAAAATATCAATTCTTATCATTTAAGCTAAAAATAATTGTTAAATAAATATTTTTAAAG
ATATTTCAATATATTTTTATTATAAAAAATAGTTCACATCATATTTAACACTCTTTCCCTTACAAGGAAAACAAAACGCGAC
TCATATTCACGCAGTCACGCGACACACCACAGCGACACAGCTTCGGCCCACCACCGTGCCACCACGCAAAGTACATCTCTT
CTCTCTCTAGAATTTGTTTTTATCCTATTTTTGTTGGGACTGATTCATTTTTGTTGTACTCTTAAATGTGGAGATGGAGAATGT
TCAAGCTACTTCAAATATGGAATCATTTATTGTTAGAGATGTTTAAATTTCATATTTTAGATTTATTGTTTGGATTTTCTTTTG
TTAAGACATTATTTATTTTATTGATGTAATTGACTAATTATTGAGATTTTATTTACATCTATATTAATTTAATTATGTTGCACA
CATTGACATGGTGTTTTTGAAAAGTCAATCCAATAAACTATACCAGTTTTAGTCCAAATGAAATGCAATTACTTAAAAATGA
TTGCACAAATGTTTGAACCTAGTATCACCTGCAAACTACCCAAAGACCTTGTCACTAGCCCACTACCAGTGGCACGTCCAA
TATGATGAGCTTCAATAAACATTAAAACATCATGTTAAAATACAATAAAGGAGATAAAATGGCAAGGTGTCAGCCTTCAAG
CATAAATCAATCTGCATTCTGCAAGCAAACATCAAATCTCCTTATTTGTGCCTTTCTTTTTAAGTCATGCAATATTATGTATC
GTTTACTGCTAAGCAAGATGAAAGAGCAATCATAACATCATGGGTCAGTACAAACAAATATACTGCAAACCGAAATGCAA
CCTTGTTTACAGCCCAATGCTTCTTTTCAATTAATTTCATTCCAACATAGCATGTAAATTGAACAAATTAAAAAAATTACTAT
CCATAACATCTATTTCGATGAACTATCGCATAGCTAATCTATTTGTTCGGGGTCTTGAAGTTAAAGCTTGGAGGACAAAACA
AAGTAGTGTACAAGTACTTGGTGCTATGGCATACCGTGCTCCTCAACATTTGTCTCGGTGTCTCCTTAAGATTGTTCCCAAA
TTGACTGAGATATAATATGAAGCAAACATTATTTTTCACTTCTAAATTCCTTTTAAGCTATAGATTGCATTACCTTAACCCAT
CTCGGTATTTGAAGGTTTTGACTGATACACATCCTATAGTCAGTCAGCTGGGCAAATGGCCCCTTCAACACGTTAGTCTTGA
CTTACAAACTATTCTATCCATTTGATTCCTGCTTCTGTGATTAATGTTTTTTATTTCATGTTTTTTTCAGGTTGGGAATGTGAT
AAAAAGTTCAGAAATATCTGGTCTTGTCCTTACTCTACTTAAGTAATTGGTGTTTTCGGTATCTAGAGGGAGGAATAAAAG
TAATTCTTTTAAAATTGTGGCATAAAAAATCATCATTTAATTCAACTCTACTTTTATATGTTACATATTTATTGTAATGTTTG
ATTTATATTTTTATGAAATTTCATCCTTCAAATCTTATCTATACAAAAATATTACTGTTAGTTAAGTAAAAAAAAATAATGAG
ATTATCTCAAACAACAATAGTAAAATGAGAGAGAAAGAAAATTTAAGTCAACAAAGAAATGATGAGCAAATGAAAATATT
TTATTATATTTAAAAAAAGATATATTTTTCTCTTATGATATTTAATAAATATAATTTCTATAAAATATTTTTTTTATTTTAAA
TCAACAATTATTATGAAATATAAGTTTTTATCAATTGTTGAGATAAATTTAAGTGAACTTGGTATCAATGATTATTGTGTAGT
TAAAGTCCTAGATCCAACTACTCATAAAAATTTAAATTTTCTTTACATGTAATATAAATAGACATAACTCTAAAAATGAAAA
CTTTTTTTATTAGTTTGTTAAAGTTTTATAAATATTTATCCTCTAATTTATTTTTTCTCCTCACAATTATTTTTATCTGCTGTAA
AAGATAAATTATAATGTATTTTCTAACAATTTTAATATACTATTATTATATTTTTATTTAATATTTAAGAATATTTCTATAATT
```

-continued

TAAACTCATGCACTAAGTATAAATTATATTTGTTTCCATGACATTAATACAAAGTATTTATTAATTTTATATACTGATACTC
ATCTTCATAGAGAAATTTAGTTATTCATCTTTAACGAAGTCACTATTTTCAATTATTTTTAATATGTAAGACTTAAATCTAAA
ATCTTGGCTCAAGGGGATTTGTCTTAACTTTTCAGTTCATCATGGGAAATGATGCTAAAGTCACAAGCTAAGTAAAGTCTTA
CCAATAATTATTTCTGTTAAGCCGAACTCAGGTAATATTCAAACGATTCAACTTTATTTTAAATACACTAACCACTTGTACTC
AGTCACTTAGTCACTTGGTTGCAACAGATTTAGTTTCACTCTAAGCAATAACATGTTGGTCACAAGAATATATATTACATAT
TAACTTTGAAAATAAAATATAATAAAATTTCTAACTCAACTTTTTAATTTTCTTATTTTCATTCTAATAGTATGGTCACTCATT
GTAATGGCCCGCCTCTTCGTTACGATATCACCACTCTAAACTGCGAAAAATTTCAATTTTTAAATGAAAAACTCCATTAATT
TGCTTATGAAAAATTAAAGTAATTTTAATTTCACGATATACATTCCGAAACAACGCATCATTACTTAAATGAATACATACAT
ATATATAGGCATAGTAACTTAGTACACATCATTCACACAATGGAAGGTAAATTTGTTCATACATATAATTAAGTTTGTGATT
TACATCCTTAATTCAACAAAAAAATTATGGAACCAACTATGAAGGAGTTGATTAACAAAACACAACTCTCTCTCAAAATAA
TCTCAACGTCATCACGTCAGTTCGGCGACTTCACATCAGAATCTCACTTTCTGCACCTTACTGCTGTCATTCTGCTCCCACG
AACAAGGTTCGCGATCATCACAAGTATCAACCACACGATACAAAATTGCAAGGGTGAGTTCATTATAAAAAGAACTAATAC
TAAATTCAAATAACCACAATTAGCAAGAAAACATTAACAAATATCATGAGCTTATACAACATTCATTAATCAACACACACT
CAACAAATAGTCATCATTCATACATAGTTCCAATTAATCATGTTCAGTATGATGCATGCACCTGATCTCAACTCTTAGATGC
AATGTGGTACCATCCCCAAGGAAATAGCATAAGCGTGTCCACACGACACTCTCACTTAGAAAAACAAGACAATAAGTGTCG
AGGTCATCCTGTCGTACACATGCAACTCTTTAACCACTCTATTTTCCCCCACCAAGGACATCCGACAAAGTCAATGCACCCC
CATGAACATACACAACATACAACGTATAAAATGTGGGCACCATCAAGTACACTGACCATGAATGATTAAAGATCCTAAGT
CATCCCCTCAGAGATGCTTAAACTCTTTAACCACTTTATTTTCCCCTACCAGGGACATCCGACAAGGTCAATGCACCCCATC
ACGAACATACACAACATGCTTCATCTCAACGCATTTCCAACATCATCAACATCTCATTTCAATATCACTCTCAACATCAACA
TCTCATCATCTCAATGACATTATCAACAACAACCACATCATTTCATATTAACATAATCATCAATAATAACATCAATTCATGT
TGACATGATCATCATTAACAACGTCATCTCAAATCAATATCATCATAATGTCAACATCACCACATATCAATTAAATTCATC
AATAACAACATCAACAATAAGTCGCATTATGCATATACATATATCTTTCATGTCTGAGATTCACATTCTCTAGGATTTCAAA
CAACACAAGTCTAATCAAGACAATAATGATATTCATCAATAATAGATATATCGCATCTCACTCGTCAAAAACATTGTTTTCT
AAAAAAAAAAATCAACATATAGCAGGGACAAGCATATATATATATATATATATATATATATATATATATATTACATTGCTTAAA
ATTATTTATGAAAAGTAAATTTAATTAATTATAATATTCAGTAACTATTCAAGTATATATAAATATAATTATCAACTTATATA
ACAGAGATATACTTTTAGCTTTTTTTATAGAAATATTACTATTAGCTTTAAAATGATTTATATATATGTGATATTTTAAATTA
CATTTTTTGGAGAAATATTTTAAATTACTTTGTATCACAATTATTATATATCTTAAATATTTATTTTTAAAAAAATAGAAAT
AAAATTAAAACTTAAAATTGAGATCAATCTAGACTGATTAAATCATATTTAAATTTTAAACTACATCAATTGAACAATGAAT
TAAAAAAACCAAAAATTGTATAAGATGATATTTCTCTTTTTCAAAATCAATCTAATCTACTCCATAAATTCCTCTTAATCGG
ACAACTATTAGGAAAGTAAAAAGGAAAATATAAAAAATTAAAAAAGTAAATAATTCGATTTTGTAAAAGTCATAACCACAT
TCTTTATTATCCTTCTCTTTTTGTTCCCTCATTGTTGCACCTGGCACATTTCTTTAACATGTTGCTTATTTTCTGATCAATAT
GAACATGATATATCTTCTCTTTATTCTGATCATGCAATTACACTAATTTATTTTCTGTTCTTATCACAATTGGCTCCACATTAT
TATTATGTCATGCACTTCATCATGGTATGTTGCACTAATATTAATGATGGTTCTACAAATCTTTGCTGTACCCCTTAAATTTC
ATTGGCTTCTGCCTTTTTTTTTCCTGGTAGAAATTAATTAATTAACATTGGTTTTGTTAATTTTCTTAAGCTCATCAAAATAT
TCATAGAAATTTTATAATATTTCCTACATAATCTCGTAAAAAAATTGTTTTGCATAAATTAACTTAATTTGTATTGTGTTTTC
CCGATTCAATAGCATATGAGAGTACAAAGCCGTATTAAAAAAAAACTAAACAGTGTTATTAGTAAAGTGGAAAATATGTAT
TTAAATATTATAAAATAATTAATTAAGAAAATAGTTAACGAATGAATAGTATAATTAATTGCTTAAAGTCACCTATAAAAAT
GATATTATTAATATTATTGTATTTAACTTATATATTATAATTTTAGTTATTTAGGCTTAGGTATACCTATAATAAAAAAATGTT
ATAGGTATAGTGGTTTAATAAACACTATTAATGTGTGACATGGGATTGAATCAAACTATAACATTTTATGAATGTTTTCATC
ATTTTAGTCTACATCACTTTAAAAAACTAAAATTCTATCATTATGCAATACAAAAAAACTAAAATGACATGATTATAAAACT

-continued

```
CCCAAGGACTAAAATCAAACAAGTCAAATTAAAAATCAAATAAGATGCCAAATTAATCACTATCTCAGTTTAATGCCAATA
CCATATCAATCAATGCCGCCAACTATCAAAAGGATTAAAATCTCACACTTATAATATTCAGGAGACTCAATTAATTAGAGA
ATAAAATTATATTATAATGATACATGAGAAAATAAGTATAATTAAGTCAAATTTTTACACATAAAAACTTAATAAAAATCAT
ATGTCTCCTGGTAGAAAAAGTCTTACTCAAAATTTTATCTAGTGTTGATTTTTTTAATGTATCAGCGTTGAATTTAAGAAGT
ATGTACATTTTTTTTATTTAGTATCACCATATGCAATTAGGATCTTAGGTTCCCAATAATATTCTAATGTATGTTCATAAACT
TTGATTATTTGAATTAATTATAAGATTAATTTTCAATTAGAAGTGAGACTTAATTATACTTAAAAATTATTATTTTTTCAAA
AAGAATGTATTTTACAAAAATCAAACTCAAATTCTAATCCATAAACTTAACTTATATTATCAAATGACTTATGTTGATTAATT
CTATCTCCATATTATGCTTTAAGGTCACAAATAACACAATCATGCGAGAAAGAAAAATAAATAAATTTATTGACGATCAAT
AGAAATTAAATAGTATCAACAAGATAAATATGTTAAGAAAATAGAAATATAATTTTTATTAATATGAAACTGTGAATAAAT
ATATCATCTTCTATAACATTATTTCATGGTTATTGATAATAAAATATTAAAACTGAATCACAACTAAAAAAATAATATATAT
ATATATATATATATATATATATATATATATATATATATATAAAGATTTAGAATTAAATTTAAATCATATTTAATGTCTATCATTAAT
GAATTATAACAAAATAAAATGTCTTTTGATTATCATAATCATTATAAGGATGTTGAAGATAACACTTTCGGCCATCGCCAAT
TTGAACAAAGATCAACCGATAAAATCCGCGAGATATTTTTGGTTGCGTATTACATAATCCATACGTAATGTTAGGTCATGCG
CAAATAGTAAACTGTATTCGAATACTATCTCTGTGTATTTTTAAATTTATCTTAAGTTAAAAAATTTATGTTAACTTAAAATA
AGATACAACAAAAATTAACATACTAGTTTGCAAATTTATTTTGATAAATAAATATATCATAAGATAATGTACAAATATTTAA
ACATAAAAATATTTAAATAATAAAAGATAGATTTAAATGTATTTTATATTTTAAATCCAGGCACAGCAATCACGCGTGCGAT
TGGCACTAACTCAGATGGAGATGGCTCTGTCATTGTCTTTTACCTGTCGACTCGACGTGATTCCTTTACTTTTGCGTCACCCT
CGTCATCACACAACACACTCACGTCATAATAACTTCTACTTACTCAACTGAAAAACGTGCTTCCAACTAAAAAAAAACCAT
AATACTAGTAATTAAGTTTTCCAACCAAACACATTAGTTGAAACTCTGTTAAAAGAAAATATTAGTTGAAGCTTTTAAGGTT
TAAGTAACAGTTATAACTGTCAAAGCTTTTAATACTAATATAAAAATGTTTTTCCGAATTACTACTATTATGTAAATATTATT
TTTTTCATTGCTATGTTATTTGTGTTTAATTTGTAGACGCACTTAATGTAAAATGTTTTTCCGTATTATTATCTAAATATTAAA
TTTTAATTGCTTTGTTATTGGAGTTTAATATGTAGACACACTTGTTTAGTAACTTGTACACTCACTTATTGTAAAATATTTTA
TATGTTTTGTACAAAATCATTTTATCGCTAGATTATAATAATTATTAAGATGATGATGGGATAAATTTCCTCTACAAAATTGA
TGTGATAAAATAATTAAACCCTATTGAATATTTCTATCAAAATATTTTACAATAATGAGCATTGATTAAACTTATGATGTATA
TTATTACACGTATAAAAAAATTGGCGTATTATTATGTATGTGATAATCATACAATTAGAAATTTATTATCGAAATATAAAAA
AACTAAAAAAATATATTTATTGATTAACATAACATATGTTTGAATTAATTTTATACAAAAAAAGTTAGTAGCTGATTTATTAT
TAAATAAAAATCATTTTATTTTATCACATGTATAAATTAAATTATTTATAACAAGGATTTTTACTTTTCATTTTAGTTTCACAA
GTACAACCTGTAAAAAAAATAATTAAATGTTTTATTACACAACTTATGTAAAAAGCATAGATTTTGGAGGAAAAGTATTATA
ACTACATGATTTTACTAGCATATATTGTAATATTCTTGTTATCTGTGTTTACAGTGTAATATAAATATAGATATAGTACGGAT
ACAGATAAAAGATAAAGATGAATATTATTTATACTTCAATGTTCGGAAGGTTGACCAATATTTAATTGGGTCCACATAGAAA
TCGAAATTGGACGAAAAAGGGCAAACCTCTTGACGGGTGAATACGTGCTCCTACGTTGTGGCTAACAAAGGATACTATAGT
AAATTCATCAAAATAACTGTATCTAAGTGGCGCATTTTCCGGTGCTAGCGGTCGCATTTTCCATTATACGCTATATTTCTGCG
TATTTATCTGTTCTTTTGGATATTTTAATTTGGGTACTTTTTTTGATGAATTTTTTAATATGGGTACTGATAACGTTCAACCTA
AAATACCAAAATAGGGTGCATGAAAACATTAAAAAGAAGAAATTTGAAAGAAAAAAAATACTACTATAAAGTGATACGA
TAGAGAATGAGAAAATTACTTTAATGCTTTTGATAATTAATATTTTAACTCGTGTATAATTTATAGGTATTTTTCACATTTTA
TTAATATTTAAAAAATTTAAAAATAAATACTAAAGATTTTATTTTATAAAATAAATAGCATTCAAAAGATAAGGAAATATAT
TAATTATTTGTTTATTATATATTGTTTATAAAAAGGTCATGTGAATAGTATCATCAAGAAAAAAATCAAGCTTTTATCATGTC
AAGAAATTCTTTTATTACTTAAATACAGTTTAAAAATTAAAAAAGTATATAAAGATAAAAAAACGTATTAATAAAACATTA
GAATTAATTAATAACTTCTATTTGATTTTTTCAAAAATAAAAATAAAAATAAAAATAAATAAAGAGTGAGAAAAAATA
TGTTACTGTTTATTATTATGAAAGTCGATCATATTCAAATGTTTGATGTTCAATATATATAAAGTAAACAAAACTGTGTTCTC
```

-continued

```
ATTTTTTTAGTCATATTTTTTAAAACTTCTGTTAAAAAAAGTCATATGTTTCAATATATATAATAGAATTTATTTTATTTAAAG
AGAAGAGCTTGAAATGAACAAGTGACAGATATTTATAATTTTAAATAAAGAAACTAGTGAACATGTTTTTTTAAAATATTAA
TAATTTTATATATAAAAATAAAATACCAACCCTTCCTTTCTCGTATACGACATACGGAACTTTTTTATTTTTAATTAAATAAA
TTATACTATTTGTCTTAGAATCCTATTTTTAAAATAAATTTTGTAAAATAAATTTATTAATTGTTTAATTTTATTACAGTTAGT
TATTTAATAAGAAAATCTATCTCTTAGTTGATTATAAAGGATACAGGGTTTTTTCTGTCCCTAAATTTTTTGTAAAGTTCACT
TTTAGTTTCGAAACAATTTTTTTTTAGCTTTTTACCCCTTTTATTTTTTTATCAACAATTTTAGTCTCAATTATCAAGTATCA
CCCATAACCGATGAAATAACAGTTATGTGTGACTTTCATTGTTATTAATTAGTCTAATGTAATAATTACTTATGAAATTTTAT
TTTTTGACAAATTATATTTTTAATCTTTTATCAATTAGTCTAATACCACTAATTATTTTAACAACACACAGGACTAAAAATAT
AATTTATAAAAAAAATTACACATATTTTTCTATATCAAAATCATCAATAAGGTGACAAGTTATGTAACTAACAATGTAAATG
TCAGGTTGTCAATTTTTTCAACATAAAATTGAATATTATTAAGAGGATATGAAATATATAACCATGTAATAGAGACATCATA
TTATAGACTAGCAAAGACTTACTATCCTACCAAGAATGCAAAATTATACAAAATCTTTAAGACATTCCATAGAACAAGAAT
AGTTGTTGGCAAAAGAAATACCACTAAAATAAACTCCTTACACCTAAACTAGGTCCACTAAAATGACATTGTGAAAATTGT
TCCTCTACAACCATATACACCAGCATGTAGCATACCAAACTATATACCAAAATTGACACATTTTCTTTCCCCCCTAAACAAC
AACCTACGTTGAACATAATGTTGTTGCATCTGATTGTGTTGAGCCTGACAAAATGCCAACCATTGATACACACATATCCATA
CTTGGTAAGAAAAGTGATTTTGGAAGATCAAGTGATTCGTGGTCTCCACAAATTGTAAGCACAACACAACTAGTACCATCG
TTTGCAACTCCTCTGTGAGGTAAAGCCACCTGAGTTAGCAACCAATCTCGTAAGAGCCTCCTTAAAAAGACATGTTGGAAA
GGGACACACACTTCCAAAAATTCTTCGATAGAAATCCTAGGAAATCTTTGTTTACTATTACATCAAGAGTAAAATAGCATAT
GCAGTTGCTACTGAGAATTGTTGAGAGCCACCATGACTCTATACCCAAGAATCTTGATTGTCCTTGGCCAAGGTAACACCA
AACAAAGTTTGCATCAGCTAGTCATTCAATTCTTCCTCCCAACAGAACAACCTACATCTCCATTTCCAACAACACTGCCATC
CAAATGATGTCCATACACCCATATCCACCATTACGTTATCTTGTGTAAGATAGATGTGATAAAGATGACGAAAAAAAAAGC
CATTAAACAAGTATCACCTAACCATTTATCTTTCCAAAACAAGATCCTTAAGCCATTTCCTACACTTTGAGTAACTAAATTA
AGAAACCAACAATCATTTGTCTAAACTCATAACATCCTTCCACTCATTAGATGTATTTCTGACTGAATTATTACTACTAGAA
TTTGAATTCAATCTCTCATATTTAAAACAAAGCAAATTATACCATATTGCATCTTTATCAGACACAATTTGCCACCTCCATTA
AACTAGAAGACTGATATTAAACAACTTCAAATTTTTCACTCTAAAACCACTTTTAACTTAGGGAGACTTGCTGCTTCCCAAT
TAACCCAACATATCTTCTTTGTCTCCAAAAAACCACTCCACATACACCATCTTTGTAATTTTATCTACTCATGTTCAAAGTTC
AGACCTCATTTGAGGCACAGAATTTCGTGCTCCTTCTCTCCTTCTCCCTCCACTCATCTTCTTCTACCTTCAAACTCTTATCC
ATGGCTTCCTATAGTGATGAGCTTGTTCTTGACTCATCTTCTCCTTAAAGTGACGTCTCCAATCATTTTCTTCTTCTCCATTT
CGCTACCATTGATCTTAAAGAAACAAAGGACTCCATTGATAGGAAGATCCAAGGCCTACAAGCTCAACATGGAGCTACATC
GTGTCTTTGGGCTTTATAACAAGAGAAATAATATAAAGGAAAACATAACAACATCGAATTCAACAAAGTAAGCCTCCCCC
TAAAGACAAATAACGCCTTTTCCACTGAAACAACTTTTTCTTAAATAAGCTAAAAGTTGGATCATATGTGGTAGCTCACTCG
GGATTAGCACCAATGACTATTCCAAGGAATATAAAAGGCAACGTTGCAGTCGAACAATGAAGAAATGTTGATGCCATAACC
ATAAAATTATCATGCTCATTAACACCATATATTTTGCTTTTAAGAGAGTTTACCTTTTGTACTTGCCAAAAATTGGAGCCAG
ACTAACATCAGAGTTGTCCGTCGTTAGTGTGGGTACTCTAGTGATCTTCGTGGTGGTGAATCTGTCAGTATCCTCTGCCTGA
GGAATGAGGAGGGAGTAAAAGGTTAAGTTAAAGTGAATATAGAACCTGATTATTTATAGTGATTGGTGAAAATCCTAGGGT
GTTGCCTGAGAGGTTGTTGCAACATCATAACAACCTCATTAGTCAGGTGTAACCGCATTGCAACAACTTTGTAACTACCTTG
ACAGCCAGATACTCGCGTATCGAAATATCATAATGACCTAACTACTTAGCCATGTGGCGCTAAGGTTGACCTTCTAGAGAA
CATCTGTGTTCATGGTCTAGGGCTGACCAAGATGGAGGGCTAATAAGGACTACTCAATGCTGCATCACTCGCCATGTCACT
CGTGAACCCTGGACAGTACACCTTCAAACCAGAGACAGGCTCAAAGATTCGTGGAATGGCTTTAAGAGCCCACAAGTTGTC
CCAATATGCCTCACCAAACATCATCAAATCATTTGTGTATTGTATTAAAGAAAAGGAAATAAAGTCATAAACTTCAAAGCC
TTTAACCCCTACCTGCCTCCACAAATTTACTAACTAAGTCATTCAATCCCTTAACCATTATAAGGGACAAAAAGACACCAA
```

-continued

AGAATCACCTTGTTTAGACCACTTTCATCCAGAAACTCCATTATTGACTACCATTGACCAAAGTAGACATACAACTTAAGC

AAGTTGCTTTAATCCACTTTCTCCAAGCACTATCAAATCCAAGACAGTCCAACATATAATCAAATAATTTATCATTAACAGA

GTCACGCCATCAATTAATGCTACGACTTAAAAAAGAAAACTAAATTTTTTAACAAAGAATAATATAAAGACAAAAAAATGC

TAAAATTTTTGTCTAAGGACTAAAACATAATTTAACTATCTAAAAAATTATTCTCATTTAAGAATGTAAGAAAATTTTATTCT

TATTCATAATTTAACATTTAAAATATTTGTATTTTCACACATTAAATATCAACAAATTTTATTCATACATTACTATCTAAAAA

ATGTTAACATATATTTAATATTTAATTAATACTAAACATTATCTAGCCAAAAAAGAAACAAGATAAAATAATGAGTAACAA

TACAACCACAATGATATTGCTAATAATAAAAGCTACAAAAAGAATAATAATAATGATGATAAATTAAAAATTAAAAAAAGA

GGGAGCAAGTGGGGGAGTTGGCCGAGTCTTGAAGTATAATCATCGTGCATGCATTTTGGTGCTGTCTTTCTTCTTTCTTATAT

TCTGCATGCACACGCCTCCTCTCTCTCTCTTTCTCTCAGTTTCACCCCTCTCTTCTCTCTCTCTCCGGTTACCATCGTCC

ATTCAAATCTCTCTCCGGTTTCTCTCCGTTCAGATTCCGACAATCTTCCGATCACACTTCATTATTCCTCTCCACAACGCGCG

AATGCGAATCCCAAACCTCACCCCTCGCGGCACCTCCTCCGCTTAAAAATTAACTTCCGGTGACCGGAACTTCCCCTCGTG

AACTTCCGGCGACCGGAGGAACCACTCGAGCTTCGCTCTCCCGCTTAATTTCGGTACGGGCGCTTCTCCGCAGCCGGATTTT

ACATCCGGCGTCGCGCGAGTCGGTGAGGTGACAGTTAGGGTTTTTCGTTCTGATTTTTCTGATTTTTTTTTTGCAGAGTCTG

TGTGGAATTGGAGTTGAAAATGGAGTCAAGGAGCTGCATGAACGTGGCGTGCGCCACCTCGACGACGATTCGGTGGCGCA

AAGGCTGGGCCCTGCGATCCGGCGAATTCGCCGATCTCTGCGATAAGTGCGGGTAATGATGCTCTAGATTTCGAATCGATG

AGCGTGTGTTGAAATTGACGCGTGAGTTTGATACGTGGATGCACGGAACACAACAGTTGATTAGAACTTTGGAGTAATTTTG

TGATTTGTTGCTTTGTTATTGTTAATTATTTGCTGTTTTGGGGTTTTTTTAATGTTTTTACTTTGAAGTATTTAATTTAGTTAT

TTCTTAATCTAAGTTTTGGCTTGTGGATACCTTTTTTTCCTTCCAATTTTCTAAAGTTAGTGTAGTGGCCTTTTTTTGCTGATTTT

TTTTTTTTTTTGCTGAATTTCAGTGTAGTGGCGTTTACACGCTTTTATGTTTTTTTTATTATTTATTTTTTAAATTGTGTGGTA

AGTAGTGGAAGACTTGAAGTTGTCGTAGGTAAAATTGGGTCGCCGAATTTTAATTGTGGCTGCTGACCAGAGACCACAATTT

AAAACGTTGTTTATGACATGTGTTTTTATATGGCATGCGTTTATTTTTTTTTACACATTTTATATGGCATGTGTTTATAATT

TACAGTATTAATTTTCCTTACTTTTTTTTAATAAATGACAAAAAAGAAATACTTGTGATAAAATGGGAACAGAGATTAAAAG

AAAAGAAAAGAAAAAACATAGTAGTTGTATAGTAACCAGTTTGTCCGATTGTA

>BAC43.FASTA.SCREEN.CONTIG1 (SEQ ID NO:175)
CAAATCCCATCCTCATTAATACTTCACACCACAACTGTTAACAAACACGATTAAGCCAAAAAAGACAATAATAAATGAGAA

GAAAAAAAATCAACTAAATGTAATTAGTTAAAATAAGCCCAAAGATACATGTTCTATCTATACAAGTTTAGTATCTATACA

ACTTTTTAGTAACTATTCAACTATTTAACTTATTAATCAATCCACTACCCTTAACTAAAAAAACATGTAACAAGCAATGTTA

ATAACAGGAAAAAGAAGCATTAAAAGTCAAAAGATGAAAGGATGAAATTTGAAAATACTAATGAATATAAAGAGGGGCAA

GTTTAGTTATGTAATTTGTAAAGAAACAAGCGCTTGATGGTAATAGAAAGTAGTTTTGCTCTGAGAGGTATACAACTATAGA

CTTCCACTACTAAAAAAAGTACTTTTTACGACTGCTGATCTACCTTGCCCTTTAACGTATTATTCGACCTTATCATTTTCTGA

TATATTTTATTTTTGGTCATGTCATGGTCATCAAGCTTCGTGGTTAGCAACGGGTACACGAAAAGAGAAAGAGAGGAACAA

GGCCAAGTTTGGATGAGAACCTGGTTTTTACTGGTAAAGGATGATCCTGGTTTTTACTGCATTTTTTATGTTCTGATGTATTT

GCTTCTAAACTTTGTATGTTGTCTTATGACTTGGCCTAGGTAAATCTTGTACAGTCTTCTAGCTTTTTTATTAATGATATCTCT

TTGCTTAATTGCTTAGAAAAAAAAACCCGAGTAATAATTCCTTTTCAAGGAAATTAAACAATGGATTTTCTCATCTAGTAAA

TCCCATATATGATTTTGTTCATGATTTGTAGTTTAACATTTAATTTTTTTATTGCGTAATGCTTTTCAAAATTTAAAACCCAC

TTGCTTATAATAGTGTTAGTGAGTTGACTAAATTGTCCACATTATTTTTTCAATTTTTTAAGGGTCTGTTAGTGGAAAGAAAT

GAAAAAAAAATTAAAGTGAGATAAAAATTTAAAACTAAAGTGTAGAAATGTGAATCTCACTTTGTTGATTTCTACTTTCTT

TTATCCTCTTTTTCTCCAAACAACACACCCTAATTGACTAAAGTTGGTTGTGTTGGCAGAGAAGCCGTTCTTCACAATTTTTA

TTTTTTTTAACAAAGTCACAACAAATGAATTAGTTGGTTAACTTCTCACAAAGTACACATGCATGTCTTACCTTCTAATTGCC

TCTATTACCATTGAACAAGCTTATAGAGCTTCATATAATTGATAGAGACAAAAAAAATTTATATCATTCTATGAAATATATAA

-continued

```
ATTTACGTGATGTTATGTAAGTTTTTTTTTTTAATAATGGATTGTTTTTTTAAGGTGACCACATTAACAGAGCTTATCTGGT
TTTTGAAAATTTCTTTTGAAATTTATCTGTGGTCCTGTATATATATTTTGTTTGCAGTAAGAATTTATCTAAATTATCCATTCA
GAGTTGTGTGTGTAGCAAAAATAGGACTTCTGATAAAAATGTGTTTTCTTCAGGTCATTCTTTTTGATAATCTTAAAAAATTA
GTACATGTATCGTAAGAGGTTATCTCCTATGATCTATCACTTCTCGTTCAAATTTGAAAACTTTGTTTTGCATATTTATGCTG
TTGTTTGATGGGTAGGACCCATTGAAGGAGATTATTTTTGGACATGATTGTGATGATTTCTAGTCTGAGTTGCATATGTTTGG
TTGTAGGGAAAAAGGTGAGCAAAGGTCCTAAGATACAACGGCTGGTCACTCCCCTGACCCTCCAAAGAAAGAGGGCAAGG
ATTGCAGATAAGAAGAGAATTGCCAAAGCAAAATCAGAGGCAGCAGAGTACCAGAAACTTCTTGCCTCCAAAAAAATAAG
CCTAGGTATATGGAATATACTGATATACTCTGAAGGTGTTTATAACAGTTAACTGGTTTTTATTACTTAATAGTTCAGGTTTC
TATTTTAACTTCTGAGTGTCTAGTTAAGCATTGCTGCTATAGTAGTGCTATGGAACTGAGGAAGCTTCAACTTGCACAAAAT
AATACTTAAAAATTAAATAGTAACAAATTTATTAAATAAAATTTGGAGCGTGTTACACGTTCGCTGGACTTGGCTCGATGCA
TGAAGCCCACTGAGCCCAGGAGTGTAATACTATTGTTTAAATCAAACTGACATTTATTACTAATTTGCTCTTAAACTATTTAT
TGTGGCAATCATAGTGTCAGACAGTACTTATTGTGCAACCAAAAAAAGTCAGTCCTTGTTGTCTTGGTTATTGCACTGCAGC
GCTCTGTTCTGAACTGCTCAAGCACTGACCCTAATTATACTACCAGATCAAAATACTTCATACAGTATAATAATATATTTTG
CACGTGTTAGATGAACAATATCGAGGGTCTTGCCTGTTTTTTATTTCCTGTGATTGATGCATACAGTACTATTTTCATTTTAA
TTTTCTACATCTATCTTTCGTAATAGATGGTTTTTATTTCCTGTGACACGCTAGAAGTCATCTCTACTTGAAATACCATAAGA
CAGTAGCATTTTTTCTTGACAGAGATTCAAATTGTCCAGTGCTTGATTGGTATTGCTTCCACTTGGAATACTACTTACAATAT
TTTTCTTGAAATTTAGAAGAAAACAAAATGATTACATGATTAAGTTATCATTTTCTTTATATTATATGTTTATAACATTTTATT
TTTTCATTTTGTACCCAATGTATGATATTATAAGTTATCAAATTAGTAATTGCTATTGCCAGGTCATTTTGAGGTCCTTCCAT
TCTGACTTTTGTCTATGTTTACAAGAAATTCGTTGGTTAAACTATTTCTTTGTGCCTTATAGTTCCTATTTTAAATTTTAGTCA
TTGCACAAGAAAATTGTGACTTGTAGTAGCCATATGAGAAAACATTAAGTGGTAGCCTCTACACATGCATAAGAATTTTTAG
TTTATACTGTGATGAGAAATCGCATCCTGTCATCCATGTCATACAGTACCATACTAATAAGTTCTAGAAAACTCTTAGTTAT
ACTCAGTTGTTATGACTTGAACCTGAAAATCAATTTTTTGTTGTAATCACAGGTTCTTGAATTGAATAATTAAGTATAGTTGG
GACATCGTGTTCGATTTTTTATTGCTAAAGGAAAGGATCAATATACCTCCAATACAAGGTAATGTTGAAAATCTCCCCATAC
TACATCGGTTTTACGATAAACGATGTAAAAAGCTTTCATTTTCTACATCGATTGATTGATAACCGATGTAGCAACGTTACCA
TATCTAGTCATTCTACATCGGTTGAACTATAACTGATGTAGAAACCTTTCATTTTCTACATCGGTTGACTGATAACCGATGTA
GAAATCTACCCTTTCAACATCGTTTCAGCCTGAGAACCGCTGCAGAAAGTTACCCATTCTACATCGGTTGTAGCTAGACAAC
CGATGTAGAAAAGCCGGCCTTCAAAGACGGTCATAAAACCGATGTTGTGATTCAACGACCCCGGGTTACCACCACGCGTCA
TAACCGATGTAGAAAGGTCGTTATAACCGATGTACAAGGCCTTTATTTTTAGTAGTGGTTTGGTGTTGTTACGTTACGCTTTG
GTGGTGACAAAAAGCTTGTGAGCTGCATGTTCTCCCGCCCATATTTGGTTTTTTCAAACTTGGAATGTAGTTAAAAAATTTT
GTGTTTATTTTTTCTGTTGGTCATAATTAAATTATTTGTTTTAGTTTTAGGTATTATAAAGTTTGGATGTTATATTTATTTTAG
GTATTTTAAGTTATTATTCAAATATATGGTATGTTAGTTTGTATGAATTTGGAATATATATTGTTTAAATTTTTGTTTTGTTAT
TTTAAATTATTTTGGGTATTCTAATAACAAAAAACCTTGTTACTAAAACTTCAAATTAAAACTTTATTCTAATAAAAAATTAA
TTACTTCAAATAAATATCATGCCAAAAACTTAAAAAACTTGTACGCTTTCAAAGTAGAAATTTTAAAGGCACATCAAACCA
TCAACTAAGTTGCTATTATAAATAATTAATCTTAAAACTAATAACTTCAAAATAAGTAAATATAATTAAAAAAATACTACAC
TCAAACTTTAGATTAAAAATTTATTCTAACAAAAAATTAATTATATGATGCAGAAACTTAAAAAACTTGAACGCTTTGAAAG
TAAAAATTTTAAAGGCAGAACGGAAACCTTTGAAAGTAGACATTTTAAAGGCAGAACAAATCATTAAAGAAGTTGTTATTA
TAAATAATTAATCTTAACATTAATAACTTCAAAATAAACAAATCTAATTACAAAAAATACTCGAAACTCAAATTTTATTCCA
AACTCAAAATAATTACTTTAAATAAATAAAAAAATGCCAAAGAAATTAATAAATAAAAATGATGCCAGTCGAAACTCAAAT
TTTATTCCAGACTCAAAATAATTACTTCAAATAAATAAAAACGATGCCAGAGAAGAGAAATTACTGATTGAGAGAAACTTT
AAAAACACTTAGAACACTCAGAAATTTTTAAAGGCACAAAGCATCAGCACGAAGCATCAACATGAAGTTGCTACTTAAA
```

-continued

GGGCACAACACACCTATTTTGTCAATACCATTGGCGATATATGCTCCTTGTTTCGCCAACACTGATTGCAAAACCAACTTAG

CCTGAACCCTACTGCCCTACTGTTATCCTGTGCCCTTTGCACCTTGCCTGCGCCCTCTGCACCGAAATCTCCAGTCAAAGTG

GCAAAAACTGTGCCAGCTATCTCGCCAGTGACACTGGCGGAATAGCCACATGTCCAGTGCAGGCGTATTTCGCCATGCATG

CTGACGATATACATGCATGCTGGCGATATACATGCATGCATGGCTGAATCTACGTAAAAAAGAAACCCCCTTGAAAATAGT

TTTAAAACAGACCTATTCTGGGAATTAGTTTGTAAAACTAACCCCATTAGGTCAATTTAGCGATGTTTGGCATGCCATCATT

TTCATTGTCCCTAATTCTCACCAATCTCATACCCAAAAGATTTTGTCACTTTGTAACAAGGGAGCTGTTACTAAGATTTAATA

AAGGACCAAAAGTTTGAACGATAAACTATACAGTATTTTTAACAATTTTAATATACTATTATTATATTTTTATTTAATATTTA

AGAATATTTCTATAATTTAAACTCATGCATTAAGTATAAATTAATTTTATATTATCATTCACTCATATATCATCATTAATATG

ATTTTTAAGATAATTATCATAATTATTATAGATGATAAAATATTATTGAATGAAGTTTTAAATTTGTTTTACAATTTTATTATA

TAACTTATTTTTTCTATTTATCAACAATATATTACTTTTATAGCCTCATTTGTTGTCCTATTTCTCACTCCCACATATAAGTTA

ACTTTGTTTTTTCTTCCTTGAATGTTTTGTCACATTGTAACAAGTGAAATTGTTAAGATTTTTAAAAAAGCAAATTGTTTGAA

TAATAAATTAAATTTCAAACAATTTTAATATACTAATATTATATTTTTATTTAATATTTTTAAGTTTTCTTAGTATTTAAGAAT

ATTTATTAACAAGACCTCTTATAGCTATTTTTTTATGGAATGACTATTTTTTTTAGTAATGACTATTTTTTTTTAGTAATGAGA

ATCTTGCATTTCTATTAACTCACTATAATAATGATGATGACGATTGAGTTAAGTTCAAGTGAAGCGATTGTATGCATGAGTG

TAAATTAGCTTATTTAGTTGACCAGACTTTCCTTATAATTCACAAAGGTTGTTACAGAAATTTGAAATTTAATGTATCTAATC

TAAGTATATTAATGCATTAAAATATATATATATATATATATATATATATATATATATATATATATATATATATATATATATATAT

ATATATATATAGATTTTAATGCATTAATATACTTAGATTAGATACATTAAATTTCAAATTTCTGTAACAACCTTTGTGAATTA

TAAGGAAAGTCTGGTCAACTAAATAAGCTAATNACACTCAGCATACAATCG

>BAC43.FASTA.SCREEN.CONTIG2 (SEQ ID NO:176)
ATTTAGGTGACACTATAGAATACTCAAGCTTTACAATCGGACAAACTGGTTACTATACAACTACTATGTTTTTTCTTTTCTTT

TCTTTTAATCTCTGTTCCCATTTTATCACAAGTATTTCTTTTTTGTCATTTATTAAAAAAAAGTAAGGAAAATTAATACTGTA

AATTATAAACACATGCCATATAAAATTGTGTAAAAAAAAAATAAACGCATGCCATATAAAAACACATGTCATAAACAACGT

TTTAAATTGTGGTCTCTGGTCAGCAGCCACAATTAAAATTCGGCGACCCAATTTTACCTACGACAACTTCAAGTCTTCCACT

ACTTACCACACAATTTAAAAAATAAATAATAAAAAAAAAACATAAAAGCGTGTAAACGCCACTACACTGAAATTCAGCAAA

AAAAAAAAAAATCAGCAAAAAAAGCCACTACACTAACTTTAGAAAATTGGAAGGAAAAAAAGGTATCCACAAGCCAAA

ACTTAGATTAAGAAATAACTAAATTAAATACTTCAAAGTAAAAACATTAAAAAAAACCCCAAAACAGCAAATAATTAACA

ATAACAAAGCAACAAATCACAAAATTACTCCAAAGTTCTAATCAACTGTTGTGTTCCGTGCATCCACGTATCAAACTCACG

CGTCAATTTCAACACACGCTCATCGATTCGAAATCTAGAGCATCATTACCCGCACTTATCGCAGAGATCGGCGAATTCGCC

GGATCGCAGGGCCCAGCCTTTGCGCCACCGAATCGTCGTCGAGGTGGCGCACGCCACGTTCATGCAGCTCCTTGACTCCAT

TTTCAACTCCAATTCCACACAGACTCTGCAAAAAAAAAAATCAGAAAAATCAGAACGAAAAACCCTAACTGTCACCTCACC

GACTCGCGCGACGCCGGATGTAAAATCCGGCTGCGGAGAAGCGCCCGTACCGAAATTAAGCGGGAGAGCGAAGCTCGAGT

GGTTCCTCCGGTCGCCGGAAGTTCACGAGGGGAAGTTCCGGTCACCGGAAGTTAATTTTTAAGCGGAGGAGGTGCCGCGAG

GGGTGAGGTTTGGGATTCGCATTCGCGCGTTGTGGAGAGGAATAATGAAGTGTGATCGGAAGATTGTCGGAATCTGAACGG

AGAGAAACCGGAGAGAGATTTGAATGGACGATGGTAACCGGAGAGAGAGAGAAGAGAGGGGTGAAACTGAGAGAAAG

AGAGAGAGAGGAGGCGTGTGCATGCAGAATATAAGAAAGAAGAAAGACAGCACCAAAATGCATGCACGATGATTATAC

TTCAAGACTCGGCCAACTCCCCCACTTGCTCCCTCTTTTTTTAATTTTTAATTTATCATCATTATTATTATTCTTTTTGTAGCT

TTTATTATTAGCAATATCATTGTGGTTGTATTGTTACTCATTATTTTATCTTGTTTCTTTTTTGGCTAGATAATGTTTAGTATTA

ATTAAATATTAAATATATGTTAACATTTTTTAGATAGTAATGTATGAATAAAATTTGTTGATATTTAATGTGTGAAAATACAA

ATATTTTAAATGTTAAATTATGAATAAGAATAAAATTTTCTTACATTCTTAAATGAGAATAATTTTTTAGATAGTTAAATTAT

GTTTTAGTCCTTAGACAAAAATTTTAGCATTTTTTTGTCTTTATATTATTCTTTGTTAAAAAATTTAGTTTTCTTTTTTAAGTCG

```
TAGCATTAATTGATGGCGTGACTCTGTTAATGATAAATTATTTGATTATATGTTGGACTGTCTTGGATTTGATAGTGCTTGGA
GAAAGTGGATTAAAGCAACTTGCTTAAGTTGTATGTCTACTTTGGTCAATGGTAGTCTAATAATGGAGTTTCTGGATGAAAG
TGGTCTAAACAAGGTGATTCTTTGGTGTCTTTTTGTCCCTTATAATGGTTAAGGGATTGAATGACTTAGTTAGTAAATTTGTG
GAGGCAGGTAGGGGTTAAAGGCTTTGAAGTTTATGACTTTATTTCCTTTTCTTTAATACAATACACAAATGATTTGATGATGT
TTGGTGAGGCATATTGGGACAACTTGTGGGCTCTTAAAGCCATTCCACGAATCTTTGAGCCTGTCTCTGGTTTGAAGGTGTA
CTGTCCAGGGTTCACGAGTGACATGGCGAGTGATGCAGCATTGAGTAGTCCTTATTAGCCCTCCATCTTGGTCAGCCCTAGA
CCATGAACACAGATGTTCTCTAGAAGGTCAACCTTAGCGCCACATGGCTAAGTAGTTAGGTCATTATGATATTTCGATACGC
GAGTATCTGGCTGTCAAGGTAGTTACAAAGTTGTTGCAATGCGGTTACACCTGACTAATGAGGTTGTTATGATGTTGCAACA
ACCTCTCAGGCAACACCCTAGGATTTTCACCAATCACTATAAATAATCAGGTTCTATATTCACTTTAACTTAACCTTTTACTC
CCTCCTCATTCCTCAGGCAGAGGATACTGACAGATTCACCACCACGAAGATCACTAGAGTACCCACACTAACGACGGACAA
CTCTGATGTTAGTCTGGCTCCAATTTTTGGCAAGTACAAAAGGTAAACTCTCTTAAAAGCAAAATATATGGTGTTAATGAGC
ATGATAATTTTATGGTTATGGCATCAACATTTCTTCATTGTTCGACTGCAACGTTGCCTTTTATATTCCTTGGAATAGTCATT
GGTGCTAATCCCGAGTGAGCTACCACATATGATCCAACTTTTAGCTTATTTAAGAAAAAGTTGTTTCAGTGGAAAAGGCGTT
ATTTGTCTTTAGGGGGAGGCTTACTTTGTTGAATTCGATGTTGTTATGTTTTCCTTTATATTATTTCTCTTGTTATAAAGCCCC
AAAGACACGATGTAGCTCCATGTTGAGCTTGTAGGCCTTGGATCTTCCTATCAATGGAGTCCTTTGTTTCTTTAAGATCAAT
GGTAGCGAAATGGAGAAGAAGAAAAATGATTGGAGACGTCACTTTAAGGAGAAGATGAGTCAAGAACAAGCTCATCACTA
TAGGAAGCCATGGATAAGAGTTTGAAGGTAGAAGAAGATGAGTGGAGGGAGAAGGAGAGAAGGAGCACGAAATTCTGTGC
CTCAAATGAGGTCTGAACTTTGAACATGAGTAGATAAAATTACAAAGATGGTGTATGTGGAGTGGTTTTTTGGAGACAAAG
AAGATATGTTGGGTTAATTGGGAAGCAGCAAGTCTCCCTAAGTTAAAAGTGGTTTTAGAGTGAAAAATTTGAAGTTGTTTAA
TATCAGTCTTCTAGTTTAATGGAGGTGGCAAATTGTGTCTGATAAAGATGCAATATGGTATAATTTGCTTTGTTTTAAATATG
AGAGATTGAATTCAAATTCTAGTAGTAATAATTCAGTCAGAAATACATCTAATGAGTGGAAGGATGTTATGAGTTTAGACA
AATGATTGTTGGTTTCTTAATTTAGTTACTCAAAGTGTAGGAAATGGCTTAAGGATCTTGTTTTGGAAAGATAAATGGTTAG
GTGATACTTGTTTAATGGCTTTTTTTTTCGTCATCTTTATCACATCTATCTTACACAAGATAACGTAATGGTGGATATGGGTG
TATGGACATCATTTGGATGGCAGTGTTGTTGGAAATGGAGATGTAGGTTGTTCTGTTGGGAGGAAGAATTGAATGACTAGCT
GATGCAAACTTTGTTTGGTGTTACCTTGGCCAAGGACAATCAAGATTCTTGGGTATAGAGTCATGGTGGCTCTCAACAATTC
TCAGTAGCAACTGCATATGCTATTTTACTCTTGATGTAATAGTAAACAAAGATTTCCTAGGATTTCTATCGAAGAATTTTTGG
AAGTGTGTGTCCCTTTCCAACATGTCTTTTTAAGGAGGCTCTTACGAGATTGGTTGCTAACTCAGGTGGCTTTACCTCACAG
AGGAGTTGCAAACGATGGTACTAGTTGTGTTGTGCTTACAATTTGTGGAGACCACGAATCACTTGATCTTCCAAAATCACTT
TTCTTACCAAGTATGGATATGTGTGTATCAATGGTTGGCATTTTGTCAGGCTCAACACAATCAGATGCAACAACATTATGTT
CAACGTAGGTTGTTGTTTAGGGGGAAAGAAAATGTGTCAATTTTGGTATATAGTTTGGTATGCTACATGCTGGTGTATATG
GTTGTAGAGGAACAATTTTCACAATGTCATTTTAGTGGACCTAGTTTAGGTGTAAGGAGTTTATTTTAGTGGTATTTCTTTTG
CCAACAACTATTCTTGTTCTATGGAATGTCTTAAAGATTTTGTATAATTTTGCATTCTTGGTAGGATAGTAAGTCTTTGCTAG
TCTATAATATGATGTCTCTATTACATGGTTATATATTTCATATCCTCTTAATAATATTCAATTTTATGTTGAAAAAATTGACA
ACCTGACATTTACATTGTTAGTTACATAACTTGTCACCTTATTGATGATTTTGATATAGAAAAATATGTGTAATTTTTTTTTAT
AAATTATATTTTTTAGTCCTGTGTGTTGTTAAAATAATTAGTGGTATTAGACTAATTGATAAAAGATTAAAAATATAATTTGTC
AAAAAATAAAATTTCATAAGTAATTATTACATTAGACTAATTAATAACAATGAAAGTCACACATAACTGTTATTTCATCGGT
TATGGGTGATACTTGATAATTGAGACTAAAATTGTTGATAAAAAAATAAAAGGGGTAAAAAGCTAAAAAAAAAATTGTTT
CGAAACTAAAAGTGAACTTTACAAAAAATTTAGGGACAGAAAAAACCCTGTATCCTTTATAATCAACTAAGAGATAGATTT
TCTTATTAAATAACTAACTGTAATAAAAATTAAACAATTAATAAATTTATTTTACAAAATTTATTTTAAAAATAGGATTCTAAG
ACAAATAGTATAATTTATTTAATTAAAAATAAAAAAGTTCCGTATGTCGTATACGAGAAAGGAAGGGTTGGTATTTTATTTT
```

-continued

```
TATATATAAAATTATTAATATTTTAAAAAAACATGTTCACTAGTTTCTTTATTTAAAATTATAAATATCTGTCACTTGTTCATT
TCAAGCTCTTCTCTTTAAATAAAATAAATTCTATTATATATATTGAAACATATGACTTTTTTTAACAGAAGTTTTAAAAAATA
TGACTTAAAAAATGAGAACACAGTTTTGTTTACTTTATATATATTGAACATCAAACATTTGAATATGATCGACTTTCATAAT
AATAAACAGTAACATATTTTTTCTCACTCTTTATTTTATTTTTATTTTTATTTTTATTTTTGAAAAAATCAAATAGAAAGTTA
TTAATTAATTCTAATGTTTTATTAATACGTTTTTTTTATCTTTATATACTTTTTTAATTTTTAAACTGTATTTAAGTAATAAAAG
AATTTCTTGACATGATAAAAGCTTGATTTTTTTCTTGATGATACTATTCACATGACCTTTTTATAAACAATATATAATAAACA
AATAATTAATATATTTCCTTATCTTTTGAATGCTATTTATTTTATAAAATAAAATCTTTAGTATTTATTTTTAAATTTTTTAAA
TATTAATAAAATGTGAAAAATACCTATAAATTATACACGAGTTAAAATATTAATTATCAAAAGCATTAAAGTAATTTTCTCA
TTCTCTATCGTATCACTTTATAGTAGTATTTTTTTTTCTTTCAAATTTCTTCTTTTTAATGTTTTCATGCACCCTATTTGGTAT
TTTAGGTTGAACGTTATCAGTACCCATATTAAAAAATTCATCAAAAAAAGTACCCAAATTAAAATATCCAAAAGAACAGAT
AAATACGCAGAAATATAGCGTATAATGGAAAATGCGACCGCTAGCACCGGAAAATGCGCCACTTAGATACAGTTATTTTGA
TGAATTTACTATAGTATCCTTTGTTAGCCACAACGTAGGAGCACGTATTCACCCGTCAAGAGGTTTGCCCTTTTTCGTCCAA
TTTCGATTTCTATGTGGACCCAATTAAATATTGGTCAACCTTCCGAACATTGAAGTATAAATAATATTCATCTTTATCTTTTA
TCTGTATCCGTACTATATCTATATTTATATTACACTGTAAACACAGATAACAAGAATATTACAATATATGCTAGTAAAATCA
TGTAGTTATAATACTTTTCCTCCAAAATCTATGCTTTTTACATAAGTTGTGTAATAAAACATTTAATTATTTTTTTACAGGTT
GTACTTGTGAAACTAAAATGAAAAGTAAAAATCCTTGTTATAAATAATTTAATTTATACATGTGATAAAATAAAATGATTTT
TATTTAATAATAAATCAGCTACTAACTTTTTTTGTATAAAATTAATTCAAACATATGTTATGTTAATCAATAAATATATTTTTT
TAGTTTTTTTATATTTCGATAATAAATTTCTAATTGTATGATTATCACATACATAATAATACGCCAATTTTTTTATACGTGTAA
TAATATACATCATAAGTTTAATCAATGCTCATTATTGTAAAATATTTTGATAGAAATATTCAATAGGGTTTAATTATTTTATC
ACATCAATTTTGTAGAGGAAATTTATCCCATCATCATCTTAATAATTATTATAATCTAGCGATAAAATGATTTTGTACAAAA
CATATAAAAATATTTTACAATAAGTGAGTGTACAAGTTACTAAACAAGTGTGTCTACATATTAAACTCCAATAACAAAGCA
ATTAAAATTTAATATTTAGATAATAATACGGAAAAACATTTTACATTAAGTGCGTCTACAAATTAAACACAAATAACATAGC
AATGAAAAAAATAATATTTACATAATAGTAGTAATTCGGAAAAACATTTTTATATTAGTATTAAAAGCTTTGACAGTTATAA
CTGTTACTTAAACCTTAAAAGCTTCAACTAATATTTTCTTTTAACAGAGTTTCAACTAATGTGTTTGCTTGGAAAACTTAATT
ACTAGTATTATGGTTTTTTTTAGTTGGAAGCACGTTTTTCAGTTGAGTAAGTAGAAGTTATTATGACGTGAGTGTGTTGTGT
GATGACGAGGGTGACGCAAAAGTAAAGGAATCACGTCGAGTCGACAGGTAAAAGACAATGACAGAGCCATCTCCATCTGA
GTTAGTGCCAATCGCACGCGTGATTGCTGTGCCTGGATTTAAAATATAAAATACATTTAAATCTATCTTTTATTATTTAAATA
TTTTTATGTTTAAATATTTGTACATTATCTTATGATATATTTATTTATCAAAATAAATTTGCAAACTAGTATGTTAATTTTTGT
TGTATCTTATTTTAAGTTAACATAAATTTTTTAACTTAAGATAAATTTAAAAATACACAGAGATAGTATTCGAATACAGTTTA
CTATTTGCGCATGACCTAACATTACGTATGGATTATGTAATACGCAACCAAAAATATCTCGCGGATTTTATCGGTTGATCTT
TGTTCAAATTGGCGATGGCCGAAAGTGTTATCTTCAACATCCTTATAATGATTATGATAATCAAAAGACATTTTATTTTGTTA
TAATTCATTAATGATAGACATTAAATATGATTTAAATTTAATTCTAAATCTTTATATATATATATATATATATATATATATATAT
ATATATATATATATTATTTTTTAGTTGTGATTCAGTTTTAATATTTTATTATCAATAACCATGAAATAATGTTATAGAAGATG
ATATATTTATTCACAGTTTCATATTAATAAAAATTATATTTCTATTTTCTTAACATATTTATCTTGTTGATACTATTTAATTTCT
ATTGATCGTCAATAAATTTATTTATTTTTCTTTCTCGCATGATTGTGTTATTTGTGACCTTAAAGCATAATATGGAGATAGAA
TTAATCAACATAAGTCATTTGATAATATAAGTTAAGTTTATGGATTAGAATTTGAGTTTGATTTTTGTAAAAATACATTCTTTT
TGAAAAAAATAATAATTTTTAAGTATAATTAAGTCTCACTTCTAATTGAAAATTAATCTTATAATTAATTCAAATAATCAAA
GTTTATGAACATACATTAGAATATTATTGGGAACCTAAGATCCTAATTGCATATGGTGATACTAAATAAAAAAAATGTACAT
ACTTCTTAAATTCAACGCTGATACATTAAAAAAAATCAACACTAGATAAAATTTTGAGTAAGACTTTTTCTACCAGGAGACA
TATGATTTTATTAAGTTTTTATGTGTAAAAATTTGACTTAATTATACTTATTTTCTCATGTATCATTATAATATAATTTTATTC
```

-continued

```
TCTAATTAATTGAGTCTCCTGAATATTATAAGTGTGAGATTTTAATCCTTTTGATAGTTGGCGGCATTGATTGATATGCTATT
GGCATTAAACTGAGATAGTGATTAATTTGGCATCTTATTTGATTTTTAATTTGACTTGTTTGATTTTAGTCCTTGGGAGTTTTA
TAATCATGTCATTTTAGTTTTTTTGTATTGCATAATGATAGAATTTTAGTTTTTTAAAGTGATGTAGACTAAAATGATGAAAA
CATTCATAAAATGTTATAGTTTGATTCAATCCCATGTCACACATTAATAGTGTTTATTAAACCACTATACCTATAACATTTTT
TTATTATAGGTATACCTAAGCCTAAATAACTAAAATTATAATATATAAGTTAAATACAATAATATTAATAATATCATTTTTAT
AGGTGACTTTAAGCAATTAATTATACTATTCATTCGTTAACTATTTTCTTAATTAATTATTTTATAATATTTAAATACATATTT
TCCACTTTACTAATAACACTGTTTAGTTTTTTTTTAATACGGCTTTGTACTCTCATATGCTATTGAATCGGGAAAAACACAAT
ACAAATTAAGTTAATTTATGCAAAACAATTTTTTTACGAGATTATGTAGGAAATATTATAAAATTTCTATGAATATTTTGATG
AGCTTAAGAAAATTAACAAAACCAATGTTAATTAATTAATTTCTACCAGGAAAAAAAAAAGGCAGAAGCCAATGAAATTTA
AGGGGTACAGCAAAGATTTGTAGAACCATCATTAATATTAGTGCAACATACCATGATGAAGTGCATGACATAATAATAATG
TGGAGCCAATTGTGATAAGAACAGAAAATAAATTAGTGTAATTGCATGATCAGAATAAAGAGAAGATATATCATGTTCATA
TTGATCAGAAAATAAGGCAACATGTTAAAGAAATGTGCCAGGTGCAACAATGAGGGAACAAAAAAGAGAAGGATAATAAA
GAATGTGGTTATGACTTTTACAAAATCGAATTATTTACTTTTTTAATTTTTTATATTTTCCTTTTTACTTTCCTAATAGTTGTCC
GATTAAGAGGAATTTATGGAGTAGATTAGATTGATTTTGAAAAAGAGAAATATCATCTTATACAATTTTTGGTTTTTTTAATT
CATTGTTCAATTGATGTAGTTTAAAATTTAAATATGATTTAATCAGTCTAGATTGATCTCAATTTTAAGTTTTAATTTTATTTC
TATTTTTTAAAAAATAAATATTTAAGATATATAATAATTGTGATACAAAGTAATTTAAAATATTTCTCCAAAAAATGTAATT
TAAAATATCACATATATATAAATCATTTTAAAGCTAATAGTAATATTTCTATAAAAAAAGCTAAAAGTATATCTCTGTTATA
TAAGTTGATAATTATATTTATATATACTTGAATAGTTACTGAATATTATAATTAATTAAATTTACTTTTCATAAATAATTTTAA
GCAATGTAATATATATATATATATATATATATATATATATATATATGCTTGTCCCTGCTATATGTTGATTTTTTTTTAGAAA
ACAATGTTTTTGACGAGTGAGATGCGATATATCTATTATTGATGAATATCATTATTGTCTTGATTAGACTTGTGTTGTTTGAA
ATCCTAGAGAATGTGAATCTCAGACATGAAAGATATATGTATATGCATAATGCGACTTATTGTTGATGTTGTTATTGATGAA
TTTAATTGATATGTGGTGATGTTGACATTTATGATGATATTGATTTGAGATGACGTTGTTAATGATGATCATGTCAACATGAA
TTGATGTTATTATTGATGATTATGTTAATATGAAATGATGTGGTTGTTGTTGATAATGTCATTGAGATGATGAGATGTTGATG
TTGAGAGTGATATTGAAATGAGATGTTGATGATGTTGGAAATGCGTTGAGATGAAGCATGTTGTGTATGTTCGTGATGGGGT
GCATTGACCTTGTCGGATGTCCCTGGTAGGGGAAAATAAAGTGGTTAAAGAGTTTAAGCATCTCTGAGGGGATGACTTAGG
ATCTTTAATTCATTCATGGTCAGTGTACTTGATGGTGCCCACATTTTATACGTTGTATGTTGTGTATGTTCATGGGGGTGCAT
TGACTTTGTCGGATGTCCTTGGTGGGGAAAATAGAGTGGTTAAAGAGTTGCATGTGTACGACAGGATGACCTCGACACTT
ATTGTCTTGTTTTTCTAAGTGAGAGTGTCGTGTGGACACGCTTATGCTATTTCCTTGGGGATGGTACCACATTGCATCTAAGA
GTTGAGATCAGGTGCATGCATCATACTGAACATGATTAATTGGAACTATGTATGAATGATGACTATTTGTTGAGTGTGTGTT
GATTAATGAATGTTGTATAAGCTCATGATATTTGTTAATGTTTTCTTGCTAATTGTGGTTATTTGAATTTAGTATTAGTTCTTT
TTATAATGAACTCACCCTTGCAATTTTGTATCGTGTGGTTGATACTTGTGATGATCGCGAACCTTGTTCGTGGGAGCAGAAT
GACAGCAGTAAGGTGCAGAAAGTGAGATTCTGATGTGAAGTCGCCGAACTGACGTGATGACGTTGAGATTATTTTGAGAGA
GAGTTGTGTTTTGTTAATCAACTCCTTCATAGTTGGTTCCATAATTTTTTTGTTGAATTAAGGATGTAAATCACAAACTTAAT
TATATGTATGAACAAATTTACCTTCCATTGTGTGAATGATGTGTACTAAGTTACTATGCCTATATATATGTATGTATTCATTT
AAGTAATGATGCGTTGTTTCGGAATGTATATCGTGAAATTAAAATTACTTTAATTTTTCATAAGCAAATTAATGGAGTTTTTC
ATTTAAAAATTGAAATTTTTCGCAGTTTAGAGTGGTGATATCGTAACGAAGAGGCGGGCCATTACAATGAGTGACCATACT
ATTAGAATGAAAATAAGAAAATTAAAAAGTTGAGTTAGAAATTTTATTATATTTTATTTTCAAAGTTAATATGTAATATATAT
TCTTGTGACCAACATGTTATTGCTTAGAGTGAAACTAAATCTGTTGCAACCAAGTGACTAAGTGACTGAGTACAAGTGGTTA
GTGTATTTAAAATAAAGTTGAATCGTTTGAATATTACCTGAGTTCGGCTTAACAGAAATAATTATTGGTAAGACTTTACTTA
GCTTGTGACTTTAGCATCATTTCCCATGATGAACTGAAAGTTAAGACAAATCCCCTTGAGCCAAGATTTTAGATTTAAGTC
```

-continued

```
TTACATATTAAAAATAATTGAAAATAGTGACTTCGTTAAAGATGAATAACTAAATTTCTCTATGAAGATGAGTTATCAGTAT
ATAAAATTAATAAATACTTTGTATTAATGTCATGGAAACAAATATAATTTATACTTAGTGCATGAGTTTAAATTATAGAAAT
ATTCTTAAATATTAAATAAAAATATAATAATAGTATATTAAAATTGTTAGAAAATACATTATAATTTATCTTTTACAGCAGAT
AAAAATAATTGTGAGGAGAAAAAATAAATTAGAGGATAAATATTTATAAAACTTTAACAAACTAATAAAAAAAGTTTTCAT
TTTTAGAGTTATGTCTATTTATATTACATGTAAAGAAAATTTAAATTTTTATGAGTAGTTGGATCTAGGACTTTAACTACACA
ATAATCATTGATACCAAGTTCACTTAAATTTATCTCAACAATTGATAAAAACTTATATTTCATAATAATTGTTGATTTAAAAT
AAAAAAAAATATTTTATAGAAATTATATTTATTAAATATCATAAGAGAAAAATATATCTTTTTTTAAATATAATAAAATATTT
TCATTTGCTCATCATTTCTTTGTTGACTTAAATTTTCTTTCTCTCATTTTACTATTGTTGTTTGAGATAATCTCATTATTTTT
TTTTACTTAACTAACAGTAATATTTTTGTATAGATAAGATTTGAAGGATGAAATTTCATAAAAATATAAATCAAACAATTAC
AATAAATATGTAACATATAAAAGTAGAGTTGAATTAAATGATGATTTTTTATGCCACAATTTTAAAAGAATTACTTTTATTC
CTCCCTCTAGATACCGAAAACACCAATTTACTTAAGTAGAGTAAGGACAAGACCAGATATTTCTGAACTTTTTATCACATTC
CCAACCTGAAAAAAACATGAAATAAAAAACATTAATCACAGAAGCAGGAATCAAATGGATAGAATAGTTTGTAAGTCAAG
ACTAACGTGTTGAAGGGGCCATTTGCCCAGCTGACTGACTATAGGATGTGTATCAGTCAAAACCTTCAAATACCGAGATGG
GTTAAGGTAATGCAATCTATAGCTTAAAAGGAATTTAGAAGTGAAAAATAATGTTTGCTTCATATTATATCTCAGTCAATTT
GGGAACAATCTTAAGGAGACACCGAGACAAATGTTGAGGAGCACGGTATGCCATAGCACCAAGTACTTGTACACTACTTTG
TTTTGTCCTCCAAGCTTTAACTTCAAGACCCCGAACAAATAGATTAGCTATGCGATAGTTCATCGAAATAGATGTTATGGAT
AGTAATTTTTTTAATTTGTTCAATTTACATGCTATGTTGGAATGAAATTAATTGAAAAGAAGCATTGGGCTGTAAACAAGGT
TGCATTTCGGTTTGCAGTATATTTGTTTGTACTGACCCATGATGTTATGATTGCTCTTTCATCTTGCTTAGCAGTAAACGATA
CATAATATTGCATGACTTAAAAAGAAAGGCACAAATAAGGAGATTTGATGTTTGCTTGCAGAATGCAGATTGATTTATGCTT
GAAGGCTGACACCTTGCCATTTTATCTCCTTTATTGTATTTTAACATGATGTTTTAATGTTTATTGAAGCTCATCATATTGGA
CGTGCCACTGGTAGTGGGCTAGTGACAAGGTCTTTGGGTAGTTTGCAGGTGATACTAGGTTCAAACATTTGTGCAATCATTT
TTAAGTAATTGCATTTCATTTGGACTAAAACTGGTATAGTTTATTGGATTGACTTTTCAAAAACACCATGTCAATGTGTGCAA
CATAATTAAATTAATATAGATGTAAATAAAATCTCAATAATTAGTCAATTACATCAATAAAATAAATAATGTCTTAACAAAA
GAAAATCCAAACAATAAATCTAAAATATGAATTTAAACATCTCTAACAATAAATGATTCCATATTTGAAGTAGCTTGAAC
ATTCTCCATCTCCACATTTAAGAGTACAACAAAAATGAATCAGTCCCAACAAAAATAGGATAAAAACAAATTCTAGAGAGA
GAAGAGATGTACTTTGCGTGGTGGCACGGTGGTGGGCCGAAGCTGTGTCGCTGTGGTGTGTCGCGTGACTGCGTGAATATG
AGTCGCGTTTTGTTTTCCTTGTAAGGGAAAGAGTGTTAAATATGATGTGAACTATTTTTATAATAAAAATATATTGAAATAT
CTTTAAAAATATTTATTTAACAATTATTTTTAGCTTAAATGATAAGAATTGATATTTTTATTATTTATGACTTGCAAATATGA
AAATGATAGATTAAAAGAAAAAAAGATCGAGAAAATATCAAAAAGGAAGATTTTTAGCATGTTATCACTTATATTTTTTAT
CTTAATCTTTTATTTCTGTTATCTTTTATTTTTCTTATCTTATCTTTTTTATCTTTACCATCTTTTAATTTAAATCTTTTATTTTT
ACCTTTAAATCTTTTATTTTTACCTTTAAATCTTTATCTTATATAATATATTTCTTCATTTGTTATTTTAAAAGAAAAGTTTAA
AGTGAAAAAGAGAAAATCAAACCTAATATAATTGGGTCAGGGTCACACAAATCAAACCAAATGCGGGTTGCGGGCAACCC
GTGGACCCCGCGGCCAAACCCGCATAGTCCGCGGGTTAAGCGGGGCGGACCAAAAAATATGACATAACCATGAACTGTTT
TAAAAAATTGGTTCGTAACTCGAGCGGATCGCGGGCGCCACGGGCCAGTCCATGGACCTGGGCCCATTTACCCACCCCTAG
TCTACAGGTTCCTGATCCTTTGCGATTAAGAGATGAACCCTAGAGGCACATCAATGGCCTCTATGGAACTTCTCATCGAATG
TGAAGCATAGCCCGTGCTTATGGCGCGAGGCTAACTCCTCCGGGGTGAGACGCCTGACGGTCGGAGCCTATGGCGGGAA
GGCAGCAAAGGGGGCAAAGGCGTGATACGAGGGGGAACCAAAGGGGCTGGTGGTGGAGCTACCAACGGTGGGGTCGCGG
CCGCGGTGGAGGCAGACGAAGGTCCGATAGCTTCTGCTCCTGGATCTTCGCAAGGCTGGCGGCCTGGTCCACAGTCATAGG
CTGGTGGACCTGGACTGTGCGGCGGATCTCCGACGTCAAACCCGAGATGAAGCAAGGCAACAGGAAGGGGCCGACAAGC
CGATAATTCTATTAGCCAAGTCTTCGAACTCCTTCAGGTATGTTAGCACTGAACCCGTCTGAGTGAGTTTGAACAAGGCATC
```

-continued

```
GACAGGATCCTCATACGGTGATGAGGCATATCGGATTTGTGCAGGAACAGAGGTGGAGTGGCAAGGGACTGGTGTGGGGTT
GGGCGTGGTGGAGGAAGGCACAGGAGCAAGGCGGTTGCGAAGCTTGTCCATATTGAGGGTCATAGAGTGCATGGTATTGTC
AAGACGAACAAGGGCCTTGTCGAGGTTGCGTGAGGCCATGAGGACAAACGAGAGCACCAATTGTTACGAACTGAACATAA
ATGCAGGAAATTAAGAGCTGGCTTCGAGGCACCAGAACCTCCAGAGGAAGAAGAAGAGCAGAGATGAGAGTAATTTGCTA
ATTTCATTCATATCGTGCTGCTTATTACATGCTATTGTATTTATACTGATTTCTACATAACAGATTTTGTCCTTTTGTGCTAGA
GGAAATCAGAAATCGTTATTCTTGTCTCCCTTGCTTCTAGCACAGATCATTCAGCATCATTCCTTAGGATCACACGTAGTCC
TTAAGGTAAGCAGGCTTCGAGATCTTTCTTTTGGTATTAACTGCTGCTTGCACCTCCTTTTCTACTTGATTTACACCCTTCTTT
GCTATAGACACCCCTGTAGTTGCTATGTCTTGATTCACATCTATTTTTTCTGAATACATCCCTTTGTATGCTATGCTATCACT
CTTCCCTATCAGAGGGGGTCTCTGGTTTTGTTTTTCCTAATTACCATTATGTAAGATCTAGCTTGTATCCGCCTTCTTCTTCTT
CTTCTTATTACAACTTTTTCACAATATTCTTTACTATATTAGCATCTAGGCCAACCTGATAAGTCACGCACCACCATAATAAT
AATATTTAACTTTTTTTTATTTTTAAAGAAAAATTAATTCCTTTATTTTTTAAATATTATTTTTATATTAAAATATATTTAGT
AAAACAGTAATATTAAAAAATTAATTTATTTTTAATGTAAAAATAATATTTAAAAAAATAAAGGAATTAATTTTTCTTTTTTT
AAAAAATAAATTTTTATTTAACAAGTTAAATTAATAAATGAATTTTTTGTTTATAGTATTTTTTAAAAATGTATAAAAACTA
ATTATATATATATTTTTAACAATTTATTTATACTGGAATACATTACATCATAAATAAAATACATGAACAATAATATTTATCTA
AGAAAAAACTGAAGATGAAGATATATTGAAATAATTTTTTCTGTTATGTTTTATTATCGAAAATTTTCACATTTTTTTTCT
AGAATGAATACCATAGTTGTTAGGTAAAAAAACTATGGTAGGTTGTAACATGTCTCCTTCCCAAGGATTAATAATCAAATG
AGGTTGATAATGGGAATGATTCATGTGTTAGTTGTTTATGCTTTCATTATTTTCATGTTTCAATTATTATTGTTAGTCCATTCT
GTTATTTTTGCTTTATTATATGTTCCATTTATGATGTTTGTCTCTTTAATTTTTAATATTTTATGTTATTTGAGTATTTTAATTTC
TTAATATAATATAATTAAGATGTGATAATCATATATTTATTGGGTTTTTAATCAATCTATTTTTTAATCACTTTGTTTTTTAA
ATTTATTTTAAGATTATTAATTAATTATTTTCAAACTATAAATAAATAATTAAACAAAAAATATTCTCATTATTTAAAAACA
AAATAATAATAATAAAAAATTTAGTTATTTTTTATCTGAAAATAATATTTAAAAAACAAGTAAATTATTTTTAAAAAAATA
TAAAAAAAGAATTTAATAATTTTTTTAAATTAAAAAATAATAGGAGCAAAGAGAAGTTGGGTTCCCTAACCCCGACTTCTC
TCTGCAAGCTAAAAAGGAGTGTTGTTTAGGAAACAATTTTGAGGCAGGTGTATTTTGGAAAAAATGAGGAGAGAGCAAGTG
TAGTGGAGTAAAAAAATCCTGTAAGGTTTTGTTTGGTAGTAAAAAGAAAAAAATAATTGTAATGAGAAAAAATAAGTTAGA
GGATAAATATCTTCAACACTTAAACAAACAAATAAAAAAGTTTTTCTAGGAAGTTCACTTAAATCTATTTTAACTATTGATA
AAAATTTATACCTGTTGATTTAAAATAAAATTATATTTATTAAATATGATAGGAGAAAAAATATTTTTTACATATAGTAAAA
TATTTTCATTTGCTGAACTTAAATTTTCTTTATCTCTCATTTTACTATTGTTGTTTGAGATGATCTCACTGAATATATTAATAA
TAAAATTTTTATATAAATAAGATTCAAAGGATAATCACCAACCAAGAAATTTTATGGAAGTATTTATCAAATAATTACAATA
GATATATAACATAAAAAAAGAGTTGAATTGAATAATAATTTTTCATGCCATCATTTCAAAAGAATTACTTTAATCACTCTC
TTTATATTATTATTATTATTATAACATCTTCACAATATTTTTATTTTATTAGTATTTATTGATTTTATTTAATAAAAAATC
ACACACTTTTCTTTTTGCACACATCTTTAATCTACATATAAGGATATTCAAATCTTGACTTCATTAATATATATTATTGTTTTT
AGGGATCAATTAGCATGTGTCTTTTCTTTAATTCTTTCTCTTTTAATTTGTTCAACATTTTTATTGTGTTAATAATTTTTTAATC
TCATTTTTTTATTTTCCTCCTAACAAAATTTATTCTATATATAAGAATTAATAAAGATTTAAATCTTTTACCACTTGATTAAAA
AACATAAATTACTATCAATTATTTTAACTTTTTATAAAATCATGATTCAGATCTTTATACAATAACATATCTCATCATGTGTT
AGTTGTTTATATCATCACTCTTTAAATCTCTTGAGTCTTTAGTTTAGAGGAGCTAAATTCAAAATAGAAATATCAAGAAAGT
AACATATGTGAGGATCAAAAGTAAAGAGACTCCCAACGTGATAAGTCACCCACCACCATAATAATACAAATAATAAAAAT
AAAAAAGACCATACTTTTGTCTTGCACAGCAGAACGAGTGAAGGTGAAGAGAGTTGACTTAAGCCAAATCTCATCACATCA
GTTCATAGCAACCAATTCCCTTGCCTTTGTCTTTCTACTCTGATCATCTTTTGTTCTTGAGATAATGGCTGCAGCACTGGTCG
GTGGTGCCTTTCTCTCTGCTTTCCTTGATGTGCTTTTCGACAGGCTGGCTTCACCTGACTTTGTTGACTTGATCCTTGGAAAG
AAGCTTAGCAAGAAGTTGCTTCGAAAGTTGGAGACCACTCTCAGAGTGGTTGGAGCTGTGCTTGATGATGCCGAGAAGAAA
```

-continued

```
CAGATCACAAACACCAATGTCAAACACTGGCTCAATGCTCTCAAAGATGCTGTCTATGAAGCCGATGACTTACTCGACCAT
GTTTTCACCAAAGCTGCCACCCAAAACAAGGTAAGAAACTTGTTTTCTCGCTTTTCCGATCGGAAGATCGTTAGTAAGTTGG
AGGACATAGTTGTCACCCTAGAGTCTCATTTAAAACTCAAGGAGAGTCTTGATTTGAAAGAGAGTGCAGTGGAGAACTTGT
CATGGAAAGCTCCATCAACATCTCTGGAAGATGGATCTCATATATATGGTAGGGAGAAAGATAGGGAGGCCATAATCAAGT
TGTTGTCGGAGGATAACAGTGACGGTAGTGAAGTGTCTGTGGTTCCTATTGTGGGCATGGGTGGGGTTGGAAAAACTACTTT
GGCCCAATTGGTGTACAATGATGAGAATTTGAAAGAGAAATTTGATTTTGATTTTAAGGCATGGGTTTGTGTTTCTCAAGAA
TTTGATGTTCTGAAGGTCACAAAAACTATAATACAGGCGGTTACTGGAAATCCTTGTAAATTGAATGATCTGAATCTACTTC
ATCTTGAATTGATGGACAAGCTGAAAGATAAAAAATTCCTAATTGTTTTGGATGATGTTTGGACAGAGGATTATGTTGATTG
GAGTCTTCTTAAGAAACCATTTCAATGTGGGATTATTAGGAGAAGTAAAATTCTTCTAACAACCCGCAGTGAAAAGACAGC
CTCCGTAGTCCAAACGGTTCAAACCTATCATCTAAACCAATTGTCGAATGAAGATTGTTGGTCAGTGTTTGCGAACCATGCG
TGTCTTTCCTTGGAATCGAACGAGAACACAACACTAGAAAAAATTGGAAAGGAGATTGTTAAAAAGTGCGATGGACTGCCT
TTAGCAGCACAGTCCCTTGGAGGCATGTTGAGAAGAAAGCATGACATTGGGGATTGGTATAATATTCTGAATAGTGACATT
TGGGAACTTTCTGAAAGTGAGTGTAAAGTTATTCCAGCACTGAGACTTAGTTATCATTATCTCCCTCCACATTTAAAACGGT
GCTTTGTTTATTGTTCGTTGTATCCCCAAGATTACGAATTTGATAAAAATGAATTAATCTTGTTGTGGATGGCTGAAGATCTT
TTGAAGAAACCAAGGAAAGGTAGGACTTTAGAAGAGGTTGGTCATGAGTATTTTGATGATTTGGTTTCGAGATCATTTTTCC
AACGTTCAAGTACAAATAGAAGTAGTTGGCCTTATGGTGAATGTTTTGTGATGCATGACCTCATGCATGATCTAGCCAAATC
ACTCGGTGGAGATTTTTATTTTAGATCAGAAGAACTTGGGAAAGAAACAAAGATCAATACTAAGACTCGTCATTTGTCATTT
ACCAAATTCAATTCTTCAGTCTTGGACAACTTTGATGTTGTTGGTAGAGCAAAATTTCTGAGAACTTTCTTGTCCATTATCAA
TTTTGAAGCTGCTCCATTCAACAACGAGGAGGCACAATGTATCATTGTGTCGAAGCTTATGTACTTGAGAGTTTTATCATTT
TGTGACTTCCAAAGTTTGGATTCTTTGCCTGATTCAATAGGTAAATTGATCCATCTGCGCTATTTAGATCTTTCTCATTCAAG
TGTAGAAACACTGCCAAAGTCATTGTGTAATTTATACAATCTGCAAACTTTGAAGTTGTGTAGTTGCAGAAAGCTGACTAAG
TTGCCTAGTGACATGTGCAATCTTGTTAACTTGCGTCATCTTGAGATACGTGAAACTCCTATAGAAGAGATGCCGAGAGGA
ATGAGTAAATTAAATCATCTACAACATCTGGATTTCTTTGTTGTGGGCAAGCACAAAGAGAATGGGATCAAAGAATTGGGA
GGACTTTCAAATCTTCGTGGTCGACTTAAAATTAGGAACTTGGAGAATGTTTCCCAAAGTGATGAAGCGTCGGAGGCAAGG
ATGATGGATAAAAAACACATTAATAGTTTATGGTTGGAATGGTCTAGATGTAATAACAACAGTACCAACTTCCAACTAGAA
ATAGATGTGCTTTGCAAGTTACAGCCTCACTTTAACATTGAATCGTTGAGAATAAAAGGCTATAAAGGAACCAGATTTCCA
GATTGGATGGGAAATTCTTCCTACTGCAATATGATGAGTCTAAAATTGCGTGATTGTGACAACTGTAGTATGCTTCCTTCAC
TTGGACAACTACCTTCTCTCAAGGTCCTTAAGATTGCACGATTGAATAGGCTGAAGACTATTGATGCAGGTTTTTACAAGAA
CGAAGATTGTCGTTCTGGGACGCCCTTTCCCTCCCTTGAATCTCTGGCCATTCATCAAATGCCTTGTTGGGAGGTGTGGAGT
TCCTTCGATTCAGAAGCTTTTCCTGTGCTTGAAATTCTTGAAATACGTGACTGCCCCAAACTAGAGGGAAGTTTGCCGAATC
ACCTTCCTGCTCTGAAAACACTTACAATTAGAAATTGTGAGCTGCTTGGCTCTTCTCTCCCAACGGCTCCCGCCATTCAAAG
TTTGGAGATACGTAAAAGCAATAAAGTAGCACTGCATGCGTTTCCTCTCTTGGTAGAAACTATAAAAGTAGAAGGAAGCCC
AATGGTGGAGTCCATGATGGAGGCCATCACAAACATCCAACCAACTTGTCTCCGGTCTTTAACATTAAGGGATTGCTCGTC
AGCCGTGTCATTTCCGGGTGGTCGTTTACCTGAATCACTGAAGAGTCTGTATATCTCGGATCTTAAAAAACTGGAATTCCCG
ACGCAACACAAACATGAGTTACTGGAAACACTGTCAATAGAAAGCAGTTGTGATTCACTCACATCTCTTCCATTGGTTACCT
TTCCAAATCTCAGAGATCTTGAAATCAGAAACTGTGAAAATATGGAATCTCTTTTGGTATCATTCTGGAGAGAAGGATTGCC
TGCGCCCAACTTGATTACTTTCCAAGTGTGGGCTCTGACAAGTTGAAGTCGTTGCCTGATGAGATGAGTACTCTTCTCCCA
AAGTTAGAACGTCTCCTCATATCCAACTGCCCAGAAATTGAGTCGTTTCCAAAACGGGGTATGCCACCTAACCTGAGAATA
GTTTGGATTTTCAATTGTGAGAAACTACTGAGCAGCCTAGCATGGCCATCCATGGGCATGCTTACTCATCTCTATGTTGGGG
GTCGATGTGATGGCATCAAGTCCTTCCCTAAGGAGGGTTTGCTGCCTCCCTCCCTTACGTATCTGTATCTAAGTGGATTCTC
```

-continued

```
AAATCTGGAGATGTTGGACTGCACGGGGCTTCTCCATCTCACATCCCTGCAACAATTAACCATAGACGGATGTCCTTTGCTG
GAAAATATGGTGGGAGAAAGGCTTCCTGACTCTCTAATAAAATTAACCATAAAGAGTTGTCCTTTGCTGAAAAAACGATGC
CGGAAGAAGCACCCTCAAATTTGGCCTAAAATTTCCCACATCCCTGGCATTAAGGTTGACAATAGATGGATTTAGCCACCA
AGGAGGACCAACAGGTATCTTCTAAGTCTAACCAACTAGAAAACTAGTTCTGTCAAGGATATGTTTCATTTCATGTCTTTCT
CCTTTTACGTTTTACTAAATCCAATTCATTCTGAAATGGAAATTGACCTTGTATATATGTTACTGAATCTACAGAGAATCAAC
AAATCATCAAAGGCAACGTGGAAATTGACCTTGTATATATGTTTCGAAGAAGTAACGATACAGGTACTAAGTAACAACATT
GATAAATACTTAAATATAATGATTCTCCGGAAAAATGTTACACATCAGTATTGTTATATTCTAACTTAATTTCTCCTTAAGAT
TATTGAGGCCAGAGTGAAAATGACCGTGGGAAACTTATTTTTGTTTTTCAGATATGGTTGATTGGCCCGGAGAAACTGTACC
TACCCATGAATCTAAGTTCAAATTTGAACTAGTGCTAAATGTAACTTTTAATTTAATTGACGTCAAATTGACACTTTCTCAAT
AGCTAAATTTTTATTTGTGAGGTTTTTTGTTAGGTACAATGTGAAGGATGAAAAGGTGTACCAAGTGAACTTTAGAAGGATT
GGATGATTTCAGCTTATCTCTTATCTCCTGTCCTATAAATTAATAGTGGTATGATTATTCTAAAAATATGATAGATATGTAGA
TACGTAAGAATTGATAAAAGCATAATAAATATACAATTGCAATTCGGTAAATTGAAGAACATACATACTTCTTAGACATTG
CTAAAAACAAAATCAAAAAATTGTAGATCATTTTTTCCTATTGTTCACAAATAAGAATGGTACTATCAATGATCAATCTCAT
TTCTTTCTTGAAATTATCTATAAACAAAACAATTTTCATATTTGGTTCATCAAGAAACAATACTTTTTATATTTCTATATTATA
TTTACTTCTATGTTACATGTCACTATATTTGATTATCATAATTTTTTTTAAAAGAATTGGTCACTTTACATATATGTACCAGT
GAAATATATCAATATATTGGTATCGGATATAGATGCATGAAGCAAATTAAAGTATCAGTACTTTGTAGCAAAACACATTCTT
CAAATCATGACATGAGGTAAAAAAATATGATGATATTTTTGTAAGTATTGGAAAAAAAAAAAAAGTAAAGCTTCTGAAAT
CAAAGAGACACTAATTTTCCACAACATCCTTCAATTGGGCCCAAGCTTCCTTTCCTATTGACAAATAACTGGTTGTTAGTGC
CAGCTTTTTCTTTTTTCTAGTTTTCCATTGATGGTTAAAAGCTAATATGAACCTGTCACTCCTTAAAATTTCCACCAAAGTTT
GGTAAATAAATATATAGGAGAGTGAATAATGCAAGCCTTGCATTCTATCTCTAAGTTACTAGGTATATGAAACAGGTATGG
GTATGGTTTTAGAAGGTATGTGGTTCATCACTATTTATATTTTTACTACAAGAACCAGGTAAACTTTATTATGGTACAGTAAA
TTTAGTGTGAGGTTGTAACTACGTTATATCCATCTAACTTAGCACGATAATTAAATTTAAAAGCAAAAAGATAAGAAAAAG
GCCAATCTAACAATTGTTACCTCTCTTGCATGAAAAAATCAGAAACAAAAGCCCCACTCTTTCCTCCATGGTGCCTGTAATT
AACAAGCACTTCAAAAATCAATGTTAATTAATTAATTTCCATAAGAAAAAAAAGACAGAAGCTAATGAAATTTAAGGGGTA
CAACAAAGATTTGTAGAACGATCATTAATATTAGTGCAACACATCATGATGAAGTGCATGACATAATAATAATGTGAAACC
AATCATGATAAGAACAGAAAATAAATCAGTGCAATTACATGATTAGAAAATAAAGAGGCGATATATCATATTCCTATTGAT
CAGACAATATGACAACGTGTTAAACAAATGTGTCAGGTGCAATAATGAGGGGATAGAGAAGAGAAGGATGATAAAGAATG
TGGTTATGACTTCTACAAAGTCGAATTATTTACTTTTTTAATTTTTTATATTTTCCTTTTCACTTTTCTAATAGTTGTCCGATTA
AGAGGAGTTTATAGAGTAGATTAAATTGGTTTTGAAAAGAGAAATATCATCTTATACAATTTTTGGTTTTCTTAATTCATTG
TTCAATTGATGTAGTTTAAAATTTAAATATGATTTAATAAGTTTGGATTGATCTCGATCTTAAGTTTTAATTTTAATTCTATTT
TTTCAAAAAAAAAATATTAAAGATATATAATAACTGTGATACAAAGTAATTTAAAATATTTTACCAAAAAATGTAATTTAAA
ATATCACATATATAAATCATTTTAAAGCTAATAGTAATATTTTCTAAAAAGAAGCTAAAAGTATATCTCTGTTATACAAG
TTGATAATTATATTTATATACTTGAATAGTTACTGAATATTATATTTAATTAAATTTACTTTTCATAAATAATTTTTAAGTA
ATGTAATAATTTTTATATATATATATATATATATATATATATATATATAATAAATAAAAATATAAACATCAATGATATCATAA
AATTTTGGTAATAATAATTTTTAAAAAAAAATTGTGAATTAACTAACCTTTCAGGTTCTAGAGTAATTTATTAATCCAAATTG
CCTTGAAGCATATTCCCATGCAAGTCAAGTTGAGGGACTTGATGGAGGCCATTTCTGAAATAGAGTTAGGAGAAGTTATTTT
CAGCCAACGAGAGATTCTGCAAGCTCCCTAATTTACCAATTCCCAATGGCAAGGATGAGGAAAAGAGTTTATAAGAGATAT
CCAAGAATTCAAGGCTTTTGAAATCAGCAATGTTGTCAGGTAGTGTTCCTCATATGGCAAGGATGAGGAGACTTTATTTCAT
GTAAAAAATATTTTCCTAGGAGTATATATATGATATATGATTATGTTGGGTCATATTTATGGTATCTCAAGGTTTCAATTGAC
AGTTTTGGCTATCTCGGAAATTTTCCTTGTACCAAAATATTAACAATTGAAACATGTTTCAAATCCAGTTACTTTTGGTACCA
```

-continued

```
TAGAATTGAAATTAATTTATTTCAAATACATTGTATTCTTAATATATTAAATATGTTAATTTGTTATTTTTTTAAAAAATAAT

CATTAGAAACAAGTTCCGGTATAGGAGGCATACTTAGTGTTTAGGCTAAGGAATAATGCCACCGGGTTCAGGAACAAGCCT

GTTGAGGTGTCCCTTAACGTTCCGTGACATCCCCACTCTTGCATGGACATTCTGTGCAGAGAAACGATGGGTGGATGGAGG

TAAGATTGGGTGAGTTCTATAATAGTCACTGATGAGAACCCCAAGAGCAGCATTGAAGTTCGAGGAATCCAAATAAGACCA

GCGTAAATTATCAATTTCATCTCTTAAATAGTCACTAAAATAAAATATAAATTAATTCTTTCAAGTATTGAAACATTCTTCAA

ATTAATCCTTATACATTGATAAAATATTTCAATGTATATATGCATTAATGGATATTTAACACTTTAGAAATTACTTATATATG

ATTTTGTTATTTTAAGGACTATTTATAAGAAAGAGTAATACTCTAGATATCAATTGGTAGTTAATTTAATTACTCTTGAAAT

AAGCATGCTCAATTTATAATATGTTGTTTTGTTGGCAATTAAATAAGCACACCCTCTCTAGAATGGTGTGTATGTACTTTTCT

GTATATGTTGTTTTGTTTGTATACTTTTGCTTGCATAGATCCCAAAACAATTGGGTGATTTTCATTCTTCTATAAATTTTCTTA

TAAATATTTAAGAAATTTTTGCTAACACAAGACTGGTGATATGATGTTAAGATTGACATAACAAGGACGTGAGAGTTCAATT

TTTCACATGCCATGTCACCCATCATAGTACCTTGTTGGCATGTATTAAGTCAACAACAAACTTCCATTTTAACCATATCTTTG

ATCACCGCAAAAAATTATTAAATTTACTATTAAATTGTTTATATTTATTTTTCTTTATTGTTGGGCTGAGATTTTTTAGTTAC

TAAAATTATAAAAGTTTTTTTAATCTCTGAATTTTGATAAATTGTTCTTTTTAGTTTCTGATTTAATAAATTAATATTTTATAA

TAATTTTAAAATGAAAAATTCAATGGCTAAAAAATAAAAATCAATTAATGGTTGCTAAAACCTAAAGGATGTTGCTAATCA

GTGCCCTAAGGCATTAGTTAATAAATTAAAATAAAAAAATATTTATTATGAAAATCATAAGAGTATGTAAAAAAAATCATA

AATAATACTATTTTATATATTTCAATAAAAAAATTATTATTTTAGTTCTTTATAACCAATTAATACCTTAAAAACACTAGTTA

ACATTTACCATAATTAAATTAACTAATTTTGAAATAAACTTCAATTATTCAATTATGTCTTAATAAGCTTGATTTTTCCCTTA

CTACTGCAAGTTTGCATCCTTTATTAAAGTGAAGTGATGAAATGTTGTCTGCCATTTACGAATATCACTGAAATTAAAGTTG

TTTTCTAGTTGAATTTATAATAAGTTTTTTTAATTGATAAATTTTAATCGTTATTTTGTGAGTTTTTGTTAGTATAAGGAAGTA

AAGTCACAAATTTTCTTTTCTTTCATAATTTTTTAACCATCCCATCAATATTATATCTCCATTTACAATAAGTTAATAACTAG

CAAGATACCCATACATTTACGCAGATCGCTCTCCTTTTTTACGCATATTCAAAATACACTTGCTTAAAAAAGATAATTAGCT

ATTTAGTATTTATATTCAATAAACATGAAAAAAGGATTAGAATATTCAAGCAAAAAAAAAATCAAAATCCTAATTTTTAGG

CTATTTAAATCATTGTCTTCTATTATTTGAAAATTGAAACTATTATTCATATTTTTACCTGTTTTATCTTCATAAATTCTATTTT

AATATATTTATTATGTATTTATGTAAAAAAATCAACACTATTAAAATTAATTTAATTTGTGATATTATTCAGTATTTAATATTT

TGTTATAAAAATATATTTAATAAATTAATATTAAAATATTTCTTATATAATTATGAAAAAATGATATTTAAACTTATTTTATA

AATATTAGTTAATAAAATTTCCATATATGAAGTTATTAAAAAAAGAGACAAAATAATATTTTGTAATAAACATATTACCTAA

TTAGATTTAAATTAATTAATAGTATAAAAATTTCAACTACATAACATAAATTATTCAAAAAATATTTCATTCATAAAATTATT

TTATACGGTTTCTAAGTAAAATTGATTTTATAGGATTTCAAATTTTTAAAAAGATATCGTGGATTCTTAATATGTTGTTATG

TTAAATATTCTTAAAGAAAAAGCTTTGTCACCCATAATAATTGGCCTGTAATGACGTTAAACACGTGATTGTTTTTCATGAA

TGATATTTTGGTCTCTATCATAAAAAATATATATTAATTAAATGTATTATTGAGTAAGTATTTTAAAAGTATTGTATTAAAA

ATTATATTTAATAATTAAATTTTAGTAGTTATTATATATTATGTAGAAGTGATTATAAAGTAAAAATGGGTTTTCAAATTAAA

AAAAAAATATTATTTTTACTCTTTGATATACAATTGTGTTAACTACTAGGCGAAAGAACTGTGTCATTTGTAATAATTTTGAG

TAGGATTATTTCTCATCAATGATTATTAAGATCCCTGTCATGATTAAAATGATTTTAATTTATGATATTATTAAGTTTTTGATA

TGAATTTGTGTGAAATACTTGAAGAAAGAGCATATTCAGTAAGTAACCTAAAACTATTTTGTAATAAAAATACATTTTATAA

ATTGATTTTAATATTTTTATTACTACATATTATGTAAAAATTAAAATTAATATAATTTATGATTTTATTGAGTAAGTAATTTAA

AATTATATTGTGATAAAAATATATTTAATAAAATGTTATATAATTATGTAAGAATGATTTCCAAATAAAAATAATATTATAA

GATTTGAAAGTAAAAAAAAAAATACTATTTCAGTTTTTTTTATGTGTAGTTGTGTTAACTACTTGGATAAAAAAAATATTGTG

GTCTATAATAGTCTTTGGCAAGATTTTCTTGTCACTAATCATATTTGTAATCTCTAGCATAACTAAAATTATTATAATATATG

ATATTATTAAGTCTTTTGGTATGTAGTTTTATAAAATATTGGAAGAAATAGTTTTGTTGCATATAATAATCCAATTTCGAGTA

GGATTTTTTCTTATGAATGATATTTATGATTTCTACTACAAAAATATTTAAACTAATTAAGTTTATGAGATTATTGACGAAAT
```

-continued

```
GATTTAAAATTAGTTTTAATAAAAATATATTAATTAATTAATTTTTAACATAGAGTCAAAACATTATTTTGTAATAAATTTG
TTAACTAATTAAAATTAAATTTATTTATAGTATAAAAATTTCAACCTTATAATATAAATATTAATGAATAAAATATTTATTTA
TAAGATTATTTAATTTTATTTTATATGATTTCTAATTAAAACTAATTTTATAAAATTTCGAATTAAAAATAAATTGTTGAGTCT
TTAATATGCAATTGTTTTAATTACTCGCGAAAGAGTTTTTTTTTTCCTATAATGGTTGGCCCATAAGAAGAATTATTTTTAGT
CATTATCCCAAAGAGAATAAAACTAATTTAATTTATGCTATTTCTTAGTAAATAATTTAATTTTTTTAAAATAAAAATACTA
AGTGACTAATCTTCCTCAAGAATTCTGAGTGCACATAATTTGACTATTCCCCTCCCAACCCAACAATTTATTTCATACACAAGGA
TCAACGGGGACTAATATATTAATTTTAATATATCTATTATATATTTACTTAAAATGATTTTATAGAATTTAAAAATAAAAATA
ATTATTATTGAATTTTTGGTTTGCATTTGTGTTAACTACTCAGGGTAGGAACATTGACGTCCATAATGACATTGAGTAAGATT
GTATCCCATCAATGATATTTGTGATCTCTATCATATTTAAAATTATTTAAATTTATGATATTGTTAAATCTTTAATATGTACTT
TTATGTGTGTTTCGTTGCATTTGCACATAAGATCTCTAGTAGGATTATTTTACTTGAATCATCCAAGGTTGTTAAACTCATGT
TTTAAATCGTAGAATTGTATGATTTTACGATTCCACTAAGCTTCAGCGAGTTAAATCGAAAGCAGAATTGAAAACGGAATA
GACTCATCTGATTTAGCGCAAACTTGGGCGAGTTTGGGTAGACTCGCGAGTCTGCTACGAGTATGTGGATTTACGAAAACC
CGAAACGGTGTCGTGTTGTAGCTACTTATTTGAGTAGACTTTGTCTACCTTGTTCGAGTTATGCAAAGTGCAAAATTGTTTGG
TTCATGCTTCTTGGCTTCTTGCTGTGATGCAGTCGGTGCTAGAGTGCTACGGTGGGGTGCGACGGTGAAAGGAGGTTTTCGG
TGTTGGAGTGCGACTGTGCAAGTGTGTGACACAGTGCTTCTGGATCTTTTGTTGGAAGGAGGTTTTCAGTGAAAGGAGGTTT
TCGATATATGGGATCAAGGTGATTTGTTGCGAACAAAAGCTAAACTTCAAATTGCACAGGGCCAGTTAAGGAACAAAAGCT
ATACTGATATACGCAGTTGCTAGTTGTTCTTCAAATTCAGAGTAAAGGTTTTAATTTGGTTCTGGGAAGAAGCTATACAAGG
TTTGTTGTTGTAATAACTTATGCTGATTGAATATTTCTGAACCATGGGCCTTTATTCCTGTTATTTACTGTTAGAATTGGATGA
ATGCAGTCTCATGAACCTTTTGAATTTATTAGATTTTTCAAGAAATTTGTGATCATGGGTTTGTTAGAAAAAAGGAAGTGTC
CTGATAGTTTGTACCTTAGAAAGTGAGAATATTGATATATAGGAAAGTAATAGTGAGAGTATTGAAGATTTGATCACCATTT
TATTTGGTTTGAAATGGAGGCATTTCGTGAAAAAGTAGAGTGCAGAATGCATAGAGTTCCTCAGAATTTCGCATGTGTTGAT
GAAGCTTTTTGAAGCATGGTACACCTTTAAGGGCATACTACTGTTGGGTTCATATATTTTTTGGTTTAATGAGAGAATTGAA
GATTTGATCACCATTTTATTTGGTTTGAAATGGAGGCATTTCGTGAAAAAGTAGAGTGCAGAATGCATAGAGTTCCTCAGAA
TTTCTAACATACTACTGTTGGGTACACCTTGAAGCATATTCCCATGCAAGTCAAGTTGAGGGACTTGATGGAGGCCATCTCT
GAAATAGAGTCAGGAGAAGTTATTTTCAGCCAACGAGAGATTCTGCAAGCTCCCTAATTTACCAATTCCCAATGGCAAGGA
TGAGGAAAAGAGTTTATAAGAGATATCCAAGAATTCAAGGCTTTTGAAATCAGCAATGTTGTCAGGTAGTGTTCCTCATATG
GAATTGTTGGACAAGGAGGGTTTCACTACTGACAAACTGCTAACTCAGTTGGAGAATGTTGTGTAAGTGTTAATGCAAAGG
ACAATACCGAAATGCATGAAAAGATCATCATCTCATAACAGACTCTTTCACATACGACCGACCACCTCAACTGCAATGGCA
TATTTTGGTGAACGAAATTGTTCTGACTCACGTAGATTCAAAGTGAATATTCATAAATCAGGCATTTTCTTTGCTTTGTGACA
ATGTCACTAAACCTTCAATTAGTTGATCTTGTTCTAGCTCTATAGGGTAATAAAAGTATATCAATGTCTGCAAAATACATCA
ATAAGATCAAGACACCAAAATATATATATGTGCTTGAATTATTTATAAACTTTTATTTTGATTCCGGGTTACAACTTATCTTA
AAATATTTTCTTTTTTCTCTGTTTCTTCTTTCAAGTTTTTAATTTAACTTCCTGGGTAATCTAGATTCCATAAAATACTTCTGG
AAATGCAGATATGATCTTGTTTTTTTTTTTGTATTTTACTATTCTATATATTTTATATTAGTGTTGTTTATTTTCTTAAAATTA
TCATACATAATTATATATGCTATATACTTGTTGATAGGGAAGAAGATAGAAGCTGGTTTTCAAGGACCAGGGCCTCCACGG
AGAGAAGAATGAGAAGAATAAGGGAAGGAACAATTGTATATTCCATTGATTGATGTTGTTATTACATAGTATTATTTATACT
GATTTCTCAATAATCGAATTTGTCTTTTTGTGCTACAGAATATCAGGAAATTGTTAAGTTTGTCTATTCCTACCCGACCAGCA
TCATTCTTCCAGATATGATGCACCTGCTTGTTTCACACCTAATCCTTGAGGTAAGTGGGTCTTGTAATTGCTCTCTTGGTCTT
GTTTTCTAATTGCACCCCCTTGCTTCTGTTGCTTGCTTGCTGCAAGTTCCCACTGATTCAAATTCCAACAGTTCTGCAAATAA
AATTGAAGAAGAAGCTAGAGGTGGGAAATACTCAAGTCATTCTCTTGAAAAAGTTGCTGCAATGATATGCAACAAAATATC
ACTATACGGAGTCAAGGTAATTATTGTGTTCACATGAACATTTCTTCCATGAAAATATATATTTTTTTACTTTGTAATCTCTT
```

-continued

```
TATAGTATGCATGGAAAATTAATTTTCTGATTTTTTCTCTGTAGTGTTATATATTATTTTTAATCACATTTTCTTATTTATTAG
TTTGTTTCTTATTTGACATCATGTAAATTTGGAGATTTGGGTTAGAAATGTTTTTGGAATTTTCCTGGTTAGAACTTGATAGG
TCCATAATGAAGGTATATAAAAGGATAGGGAAAAGAGGGGGTGGGGAATAGAAAAAGAAAGGACAAATGGGCCTCAGAA
ACAAGACATGCTTGTGTATGACAGCAGAAAGAATCAGCCGTACAAGTTGCACTAGCTGAAGTGGAAAAGGAACATAGGTT
GGCATAATGGAATGGATAGCATTTGATCTTTAATAAATTTTTGCTTTGTAATAGGTTCCTAATATTTAAAAAGTTTTTGTTTGA
AATACTTATCATTAGTCAAAATCTGTTATTTGCTCACACGATCGTTAACCAGCCACACAGACATGTCATGTGTGATTTTTGTC
TGACTGAGATTAGGATTAATGATAAGAAACTATAGTCAAAATCCCTTGGGCATAAAAGAATCATTCTTCAGCAAATAACGG
ATTTTGACTAATGATAAGAAACTATAGTCAAAATCCCTTGGGCATCAAAAAATCATTCTTCAGCATTCCTCTACGTTTTCAC
ACAACCCATTATAGTTTCTTCTATACCTTTCTTATGGATTTGTCACTATGACTTCGTCACTCGTGAAGATCCAAGGTGAAGAG
GTCCTCACCAACGATTTTTAGGATCTTGCAATCAATTTTACATTTTCAAATCAAACCAAGCCAACTCCCAACTCAAGAAATT
CACATGGATAAGGTTTCTAAGAGAACACATCAAAATAGTTTCATGGGTAGAAGAAGGTCAACAAAACCTTACCCTAAAATG
CGATTCCGCTCGGTCCATTGCATAGAGCACGAAAAAATGAGTGGGATAGCGATGTCTGAACTTGTCGTCGACCTTTCATAG
TTGCGAGCTCTTTTTGCAAACCCTTGCTTTCATGGTTGTCTCTTCTTGTTCTCCCTTCTTAAAGGTCACCACCAACCCAGCCA
TCGGCCACCACTGGTGTTGCCAGTCGTGCCACTGCTCGTGCCAGCGCCAGCTACCACCAGTAACTTCCTTCAACTCTCAAA
CCTCACTTCTCTCCCAGTCTCTCTCTCACACTTGGCCCTCAAACTCACTTGTGTGTCGTAGGTGAAGAGAAGGAAATGATGA
AAACAAAGAGGAGGGTTTTCTTTGGGGAAGGGGGGTCCATGAGTGATTTTTTAGAGAAGGAGATTTGTTGTTGCCATGGGG
AGCCATGGTTCAAGAGAAGAAAAAAAGAAAATGGGTTAGAATTATTGTTGTGTTGCTGCCATGGGGTTTCAAGGGAGGTT
GGGGGGTTTTGGAGACACAATAGCGGTGGTGTGGAGCTAGTGGAGGAGTTGGTTGGGGACTGGTGGGGGTGGTTTGGAGGA
TTCGGGGACTTAATGATGTCGTTTTTTTACTTTTTTCTATAAAAAAATAAAAAATCTTACGTGATCGGTTATCGATCACATAT
GAAGATAATGGATTTCGACTAACGGCAGGAACTTCGAACAAAGCTTTTTAAATATTAGGGACCTATCACAAAGCAAAATT
TATTAGGGACCAAATGCAAAAAATGAGTATTTATCAGAGACCAAAAATATATTTAACCATTACCTAATTGCAACTCACTA
TGTGATAAGTTTGTTGACTTTTAAAATAATTATTTTAAAGTAATTCAAACAATAATTTATAATAGTGTAAAATCATTTTACAT
CATCAATACATAAGTATTAAACTCGATATCTCTCTCTATATATTTTCTGTTCGAGATTGATTGAAATTATCTTATTTGCTTAA
CATATTAAAATGCGTCATTTTTAATGATATTATTGGTCTATAGTTTTTATGTAATACATTTAATAATGTTTAGAAATATTTGTA
TATAAATAACTTTTATCTATTTTTTCACCAGAGCCTATGAAATGTAAGCACAGGTTTGTTAATGAGTAGCACAACATGGACA
GTTTGTCAAAGGCCCAATAGCATCTTTAATGGGATTCTTGAACTCAAGAACCCTATCCACTAGATCTACTATTATTCTTATTA
AGAGTTTTTTAAGATGGAGATTGGGTTCTAGGAAAAGAACTACTATTTTTTCAAAAATATTATTTTTTCTTGTGCTAGTAAAA
TCTAATAATCCAAATTGGATTCTACTATTAGAATAACAAATGATAGAAGTTCTTGCATCCTATATAACATCATGGGACTCAC
TCTAATAATCCAAATTGGATTCTACTATTAGAATAACAAATGATAGAAGTTCTTGCATCCTATATAACATCATGGGACTCAC
AAAAAATAATCCAAGAACCTAAAATGGATTCTTTGACAAAAATGTTCTAAGAATCTCAATATTTTCCCACTTAAGAAATATA
ACTATCAAATCAATATAATATGAAACGAGTTCAATCTTTATTGATTCACTTGACGCAAGCTATATGCACAACTGACATAATA
GATTTTAATTCTAAATAACATGCAATAAAAATATAACAAACCTGTTCCGGAAAAAGCCTCCTCAAAATGAAGCACATTCAG
TCCCCCCACAATTTTTACAAGTTGGGGTCTTTATGCTGCATCAAAATATTCCATCATATCCCGCAAATGTTTCGTGCTATTAA
GTTTATGTTAGTTGTCCCTTCATGATGCATCACCAGCATATCATAAACAATCAGTTAATCCCTTATTCTGCCGAAATAGTCG
GATTATCGTCAATCCCCCTTAAGGTGGTCGTTTGATCCCGCTTGGCAAGGCCCAACTTTGAAAGTGAATTGACCTAAGCCTC
TTTTATGGGCTTGATGCGTGATAGAAGATCGGAACATAATCCAATACATTCCAATCTGAACCAAAAGATAACCCCTTAGCTT
CAAGCACACAGTGCGTAAAAGCTAAAGATGTAGAAGATCGGAACATGATCCGATCTAGACCAGAACAAAACCTAAAACCA
AACTACTAACTGATCTATAATTTTTTATACATCATAAAACTAAAAAAACAAAGCAAACTAAGCACATAATCTTACAATCCCT
ACTGAATTTACTAAAAGAGACACAGATAGTTGAGGTGGGAAATGTTGCCAAACCAGAATGAATTATCACGGGAAAGTATG
GCTGATGTGGTTACAATTAGGAGTCTTAATTCATCTTAAAGCATTAATATTTTTTAACTTAACAAATATAATTAAAGAGAAG
```

-continued

```
TAACGAATAAGATAATGATCTAAAATTCTTGTATTGATTGAAAATAGCGTAAAAAGATGTTTCAAAGATAATGATACAAAC
TCTTTAAATGCAAATGGTTACATGCACAAAGCACGTATATATATATATATATATATATATATATATATATATATATATATA
TATGAATATATCTACGTACATTCATATATGTATGTATATGCAAACATATATACATGGATGCATATATATATATGCACTAA
CAAACATATATACATCTGGATAGAGAGAGGATCAGAATAGCAGGACAAAGACAAACTTGTATTTGTTGCTTCCATACTAGA
ATTGCATTTTCTTCAGGGTTAGATGCATCAACTGTGTGGGAGGGAAATTTATTAACAGCGCTAAGTATTCTCCTAACCTTAA
GCAGGATCTCCTTCTGGTCTCTTGCCATCTGAGCTTGCATGTCAATGATGAAAAACCTGACAAGCGAGTCCGCAAGTGCCTC
AAGTTGTTCCTGGTAACAAGCTTTGTCGCATTGACCGAAAAAACCAAGGTGACGTTGACCAAAAAATAGTCCTGACAAGAT
GTTGGTAAAAAAATATAATCGGTTGATATCGATCACAAACATCATTGACTAAGGTTAACAAAAAAATTTCTAACCGACATT
GATCAAAAAATAACTTCGACCAAGGTCGATCAAAAGAAACGTAACCGATTTCGGCCAACAGAAATATTTTATATGATAGCC
TTTAGTTGCAAAAAGTGTGAACCAGGGGGTATTTTGACAGCCGTAAAACATATCTCATGGCAGTGGTTGTTATATAAGGCA
AAAAACCATGAACTTTCTTCTCTTGCTGGTGTTTGGAGCCACTTCAAATGTGATTGATGTTAGAGAAGTTAACAGTGGCATT
TTTTAGGACTGAAAGTTAACTTAGGAGAAACCATTTTTTTATGTATGTAATACGGTAACACATGTACCTCTTGCAGAGATTG
GGGAGAAATTGCAACTTTTCTTTTTACATTTTGCCTTAAAAAAAGTGTTCATATTTATAAAAATAATTTTCTATTTAACTTGG
ATATTTTTTCTCATACTACTACACTAAGGTATATACAACCTAAGGCGTGTTTCTTAATTTGGAGAGTGATGCTTGATTGATTG
ACTACCAACGAAGGATAATCTAAAAAGGAGAAACACCATTTATAATCCTCATGAGTGCTTATGTCCCTTTTGCCTTGAGGTA
GATGAGTCGGTATCTCACTGTTTCTTCTCATGTCATAAAATTCTTGGTACTAATTTGGAGGCAATGTTACTCTTGGCTGCTGG
CTGCATGTAAATGTGGTGTTGCCACAATGACCAGAATCACATTTTTGGCAAGATTCTGTATTCGTAAGTTCAAAGAAGGAGG
CAGATGTATGGAGGCGGTGTGGGCATCAGAAATTTTGGTGTGTATGGAATGCTAGGAATGAGTGTATGCTAAGGAATTAA
TGGCTCTTTCAATGCTGAGAAAATTACGCAGAATATATTATTCTTTGCACGATCGTGGATTAATAAAAGCCAGAGTCCCTAA
TTTTAATTATTGTTTTACTTAATGATATATGGCACCTGGAGCTTGTTTCATGAAGAGACAATTTTGAATGAAATGTGAAGTTA
ATTTGATTCGGTGGTAGCTGCTCTTCGAGTGGGATCATCCCAAATGCAACCGATGTTTATGTGCACGATGGTGGGGCTGGT
TAGTGATGCCGCATCAATGTTGCATGGCTTTAGACATGATTTTAAATTGCAATTATGATTGCGTTGCATGCAACGAACCTAA
AAATCTTACATTGTGGATAATTATGGAAAAATACAAACTGATGTGATCATAATTATAATTGTGATGTGATTACAGAGTCAAA
ATACATTAGCGTTATGACTGCAATTATGGTTGCTGACTACATTTTAAAACCATGACTTTGGGTGTAATGGTCCATGTTCGAA
GCTAGCTATCTTTCTTTCTACTGTCACTGGTGTATATGTTTTTGGATCTTAGGTAATTTTGGTACCATTTAATACAAATCATTT
TGTTGGAAAAAAAATACGGTAGCCTACATGCAATATACAAAATAAAATTGAATTACTATATATTATCATAAATAGTAGAGT
ATAAGAAGTAAAGAAAATTCTAAAGATAAACATGCATTTAAAAACATATGAAAGAATTTTTTAACTATATATATAACATCTT
TAATTAGCTTAATAGAAATGCGAAAGTACAATAAAAAAGCAAAAACATAATAGGCGTGACAAATCGGTTGCTTATATACAA
TAAAGACAATAAAGTTTGAAACTAAAACCTTATCCAGACTATCCAAATATCCCTAATTAATCATGAAAAAATTAGAACAGA
AGACATTTAATAACTATAGCAACAGTAACAGCAGCAGCTATAGCTAATGGCGCGATCACCGAATCGGAAAACTTTTCATCA
TTGAAGTATTCTATTTCACTAACCCTAAGCAAGATCTCAAGTTGATCGCGTGCAATAAGAGCTGGCATTTCAATATTGAAAA
ACCTCTCAATTGAGTCTGCAAGATCTTTAATTTTAGTTTTCCACGGTAAGAATTCTTAGCCACAAAATTGTATTTCCCTATTT
TTGAACACTTGTAAACAACCTCTTTGCTCTTCCTCAATAGTTGTATCAGTGGCTCAAGTTCCTGCTGTGAACGACCCAACAT
ATTCCTGTACTTACCTATCTCCTGCCATGTTTACGCTACATATTTTCTAGAATGTTATTTGAATTTCATTAAAAATCATAAGA
AGCAAGTTTGAATTTTTCAGTGAAATTTTTACTTAGGTTTAGTTAGACAAACCCTATTTAAAGCTATATTGTTTTGCTTATCG
GAACCAAACCAATTAGTTCGGTTTGAATTTCTTAGTTAAATCAAGTCTGGCTTAAACCAAATCGAGCTAACCCTAGGTTAAT
TGTTTCAAAGGTCGGGTTGAAGCTCTTTAAACTTGAGAATGTGTTCTACAAACCGAAGTACCTTATTATTTGAATATCT
AATATTTTTTGTTTTTACATTATTGTTGAATCCATTTTATATGATTTTTTTTTACAAAATATTAAACTTTATTTACTAAATAA
GATTTATATAAAATTCATGAAGGTAAAGTAATATTTTTATCTTTTAATGTAAGGCTTGGTTTCACTTTCGTCCTTCAACTTTT
TTTTATTTGATTTATTTCAGTGATCATTTAATATTTATGGATTCTTCCTTAAGGAATCTTGATATTTTTCTATAGTTTTAATTGT
```

-continued

TCTTCGGTTATTTATTCGGAAATTGAGAGGGGATCATCACCTCCAAAGATTTCCTCGCTCCCATTAACAAAAATGTCTAAAC

AATTACCTTCCTTCTAAAATTTTTGTGAAGTACCTCCACTAATTAAACTCAACATATTCTCCCAAACTTCATTTTCTTTGAAA

ACAATGTTGTCTAATTCAAGACGCTTTGATATAAAATATTTAGTCGCTAGAACGAGAAAAAAATTGAATAAAAAGAAGGG

ATTTTTTTCTTCTTAATGTACTTCATGCTACTTATTTGTTGGCAATCATTATTAATATATATTATCTTATATGAGACAATTTTC

AACATTTAAATGTTAATTTTGTAAGTATCTTGGTAGTATCCTTTTTTGATAAGGAATAGATATTATTTTGAGATTATATTATG

ATGATGAATTGTCTCATAAAAACACGAGGCAAGCACTTGAAAGGAACAAATTCTCTAATTTCTTAGTGGGTAGTGGGAGAG

AGGAAGTAAACTTGCTTCAATATGCAAATGACGCTTGACGCACTCTTTACAGGAGAAGCAACCATTTCTAAGGTGCTTACC

ATAAAAAGCATTTTGAGAGGCTTTGAACTTGTCTCGGGCCTCAAAATGAATTTCCATCAAGGCTTTTGTGGTGCCTTGGGAG

TGGATATTGATACCTTGATGAATTATGCAAGCTTGTTGATTTACTTGAGACAAACTATATGCACAACTGACAAAATGGACTT

TAATTCTAAATAGCAATAAAAAGATATATAATAAACCTGTTTCAGAAAAGGCTTCCTCAAAATGGAGGCTACTTCAATCTA

GTACGGTAGTTGACTTACTAAGTACGAAACAACAAATTATTAAGTTGATAATTAATTAAACATGATTTTAAATACTTACATA

TTTATTCACATGTAACTATAAAGATTTAGTAAGAGCATAAATAAAAAATGTTGTTATAATATATAATTTTAAATTTAATATAA

TAAAAATGTGTTTGCAAAATAGAAATATAAATATAAAGCGTGACAACACATGTTTTTCGTTAATAATAATAATAATAATAAT

AATAATAATAATAATAATAATAATAATAATAATAATAATTACAAATGGGTTTTGACAAAATCATACCTGGCGAAAATA

TGCAGTTTAGTGACGGAATTAATTTGTGATTCATGCAATACAATTTGTACCAATCATCATCATCATCATAATCTCTTTTTCGT

TTTATTTATCAACGTTGCTACTTAGTACGAAAATTATTTGCACAAAATACAAACAGAATGATGCTATCTGTTATGAAAGGTA

AATCCACACGAATTACACGAAATATAGAATGGACGGTTATGATTTTATAAAATGAATATCGATTAAAAAAATTTAAAAGGC

ATGTAAAAAGAGATTTACAGACATCAAACTTCGTGCGACTTTTACAAAATCCTCTTTCCTAACACAGCATTATATTTTCCAT

ACACAAACCGTAAACTATAGATTCTAAAGGGTATACCTGACTTATTAACAACTTTTTAAAAACTAATATTCATTAAAAATAC

CAAATAGGTTTTGACATAATCACACCTCGTGCAGATTTGACAAAAAAGAATTCTTACAATTTATTTTTCCTCAAATTGGTGT

TAAAATTAAATATATGTGACTAGTCAAGTAGGTGATAACAAGTTGCAGCACTTGTATATATGAGTGATGCAAAGGATTCGT

GCAATTTATTTACGAAAATTATATATTGGCATGAAACACACGAACTGTAAACTATATATAGTCACTAACTTGTATACGTACG

AACTGTAACAATAAATTTTAAAATAAAATATTAATTACAAATATAAAATGGGTTTTGACAAAATCGATCACACCTCGGGCA

GATTTGACAAAAGATAATTCGCCACGAATTCTTTTTCGTCAATTATTTAACACAACCTTCCTTTTACGAATTGCACAAATCC

ACTTTTAAAATACAAGAAAATTTTGTTTTAAAAATTCAGCCAGCCGACATAGAGGTGTATGCAGGTAAGTTTGGATTGAGTT

TCATCATACCTATGACTTAAGAATGAGTTGATTTGAGTCATTTGTATACGATTTTAATTAAATTATTGGGTTAAAATATTTAA

ATTTGTATGCTATTTATTAAATCCAATATTTATATAAGCTAAAATTCTTATTAATTAGAATACTGAAAACATTACTTATAAAT

TAAATATTGTCAGATGCTGCGACTAAGTGAGGTGGTGGAAAGATGTCAAGAGTTGAACTCTAATTTTTGAAAGAATAACAA

TGACACTCGGTACTTATTCAACTCTCTTGTTATGCACGAAACATATATTTAATAATAAATTCACGCGCGTATTTATAAAATTA

TATGAGAATTTTTTGTATAAAAATTTAAACACATAAATTATATTAATTAAAATGTTATGGTAATTTTAAAATATGAATGATA

AAATGATTCAATTATTATACTTTAATTTTTAAATAAAAATTGATTTTTATAATATTTAAAGTTTATAAATAATATTTTGAATA

ATTTTACATATAAATTAATTAAATTAAATGCAAAAAACTGAAATTAAATATTTCTTAAAACTAATTAATTATTATATGAATC

ACTTTATATTAGTAATTGCGAGCTGCTTGTCTCTTCTCTCCCAACGGCTCCCGCCATTCAAAGTTTGGAGATAATTAAAAGC

AATAAAGTAGCACTGCATTCGTTACCTCTCTTGGTAGAGACTATAGAAGTAGAAGGAAGCTCAAGGGTTTTTATTTTAAAAA

ATATATAAAAAATGAATTTAATAATTTTTTAAATTAAAAAATAATAGGAGCAAAGAGAAGTTGGGTTCCCTAACCCCGACT

TCTCTCTGCAAGCTAAAAAGGAGTGTTGTTTAGGAAACAATTTTGAGGCAGGTGTATTTTGAAAAAAATTGAGGAGAGAGC

AAGTGTAGTGGAGTAAAAAAATCCTATAAGATTTGTTTGATACTAAAAAGAAAAAAATAATTGTGATGAGAAAAATAAG

TTAGAGGATAAATATCTTCAACACTTAAACAAACAAATAAAAAAGTTTTTCTAGAAAGTTCACTTAAATCTATTTTCACTAT

TGATAAAAATTTATACCTGTTGATTTAAAATAAAATTATATTTTATAAAAATTATATTTATTAAATATGATAGGAGAAAAAT

ATTTTTTACATATAGTAAAATATTTTCATTTGCTGGACTTAAATTTTCTTTATCTCTCATTTTAGTATTGTTGTTTGAGATGAT

-continued

```
CTCACTAAATATATTTTACTTGACTAATAATAAAAATTTTATATAGATAAGATTCAAAGGATAATCACCAACCAAAAATTTT
TATGGAAGTATTTATCAAATAATTACAATAGATATATAACATAAAAAAAGAGTTGAATTGAATAATAATTTTTCATGCCAAA
TTACTTTAATCACTCTATATTATTATTATTATTATCATTATTATAACATCTTCACAATATTCTTTATTTTATTAGTATCTATTAT
TTATTTTATTAATTTTATTTAATAAAAAATCACAAACTTTTCTTTTTGCACACATCTTTAACGTACATATAAAGATATTCAAA
TCTTGAATTCATTAATATTATGTTTTTAGGGATCAATTAGCATGTGTCCTTTCTTTAATTCTTTCTCTTTTAATTTGTTCAACA
TTTTTTTTGTCTTAATAATTTTTTAATCTCATTTTTTTATTTTCCTCCTAACAAAATTTATTCTATATATAAGAATTAATAAAAA
TTTAAATCTTTTACCACTTGATTAAAAAACATAAATCATTATCAATTATTTTAAATTTATAAAATCATGATTCAGTATTAGAT
CTTTATAAAATACCATATCTCTATGACAATTTTAATGATTAGGTTGAAATATAAACTAACACGAATTTAAGTAAATATTTCA
CTATTTACTTTCACATTGAAAAATTGATTTTAAATTTTAACTTTAGAAAAAAAATTCTAAGTTGAGGATCTTTACATAACTTT
TGGATTTAACAAAAAAATTCATTTTCAATTTTACTATTAACTTATTTTTTAAATAAAAATATCCAAAACACATGTGCAAACTG
CTTCAATACAACTTGTCTCACAGCATCAAAGCACAGGAACATAATTATGCACAGTACCCTTGCAGCCATCCACACATATCA
CCAAGAAAAAAACACACACCACTGCTCCACACGGTTTGGAAAGCGAGAAAGCTGGCCATCACTAACTTTAATTATAGCATT
TTAGAAATATAATCCATTTTTTTAAAATTAACGGTAGAAATATCATCACTCTTTAAATCTCTTGAGTCTTTAGTTTAGAGGAG
CTAAATTTAAAATAGAAATATCAAGAAAGCAACATGTGGGGATCAAAAGTAAAGAGACTCCCAACGTGATAAGTCACCCA
CCACCAATTCCCTTGCCTTTTGTCTTGCACAGCAGAACGAGTGAAGGTGAAGAGAGTTGACTTAAGCCAAATCTCATCACA
TCAGTTCATAGCAACCAATTCCCTTGCCTTTGTCTTTCTACTCTGATCATCTTTTGTTCTTGAGATAATGGCAGCAGCACTGG
TCGGTGGTGCCTTCCTCTCTGCTTTTCTTGATGTGGTTTTCGACAGGCTGGCTTCACCTGAGTTTGTTGACTTGATCCGTGGA
AAGAAGCTTAGCAAGAAGTTGCTTCAAAAGTTGGAGACCACTCTCAGAGTGGTTGGAGCTGTGCTTGATGATGCCGAGAAG
AAACAGATCACAAACACCAATGTCAAACACTGGCTCAATGATCTCAAACATGCTGTCTATGAAGCCGATGACTTACTCGAC
CATGTTTTCACCAAAGCTGCCACCCAAAACAAGGTAAGAGACTTGTTTTCTCGCTTTTCCGATAGGAAGATCGTTAGTAAGT
TGGAGGACATAGTTGTCACACTTGAGTCTCATTTAAAACTCAAGGAGAGTCTTGATTTGAAAGAGAGTGCAGTGGAGAACT
TGTCATGGAAAGCTCCATCAACATCTCTGGAAGATGGATCTCATATATATGGTAGGGAGAAAGATAAGGAGGCCATAATCA
AGTTGTTGTCGGAGGATAACAGTGACGGTAGAGAAGTGTCTGTGGTTCCTATTGTGGGCATGGGTGGGGTTGGAAAAACTA
CTTTGGCCCAATTGGTGTACAACGATGAGAATTTGAAACAGATATTTGATTTTGATTTTAAGGCATGGGTTTGTGTTTCTCAA
GAATTTGATGTTCTCAAGGTCACAAAAACTATAATAGAGGCGGTGACTGGAAAGGCTTGTAAATTGAATGATCTGAATCTA
CTTCATCTTGAATTGATGGACAAGCTGAAAGATAAAAAATTCTTAATTGTTTTGGATGATGTTTGGACAGAGGATTATGTTG
ATTGGCGTCTTCTTAAGAAACCATTTAACCGTGGGATTATTAGGAGAAGTAAAATTCTTCTAACAACCCGCAGTGAAAAAA
CAGCATCTGTAGTCCAAACTGTTCACACCTATCATCTAAACCAATTGTCGAATGAAGATTGTTGGTCAGTGTTTGCGAACCA
TGCATGTCTTTCCACGGAATCTAACGAGAACACAGCAACACTAGAAAAAATTGGAAAGGAGATTGTTAAAAAGTGCAACG
GACTGCCTTTAGCAGCAGAGTCGCTTGGAGGCATGTTGAGAAGAAAGCATGACATTGGTGATTGGAATAATATTCTCAATA
GTGACATTTGGGAACTTTCTGAAAGTGAGTGTAAAGTTATTCCAGCACTGAGACTTAGTTATCATTATCTCCCTCCACATTT
AAAACGATGCTTTGTTTATTGTTCGTTGTATCCACAAGATTACGAATTTGAAAAAAATGAATTAATCTTGTTGTGGATGGCT
GAAGATCTTTTGAAGAAACCAAGGAAAGGTAGGACTTTAGAAGAGGTTGGTCATGAGTATTTTGATGATTGGTTTCGAGAT
CGTTTTTCCAACGTTCAAGAACAAGTAGTTGGCCTCATCGCAAATGTTTTGTGATGCATGACCTCATGCATGATCTAGCCAC
ATCACTCGGTGGAGATTTTTATTTTAGATCAGAAGAACTTGGGAAAGAAACAAAGATCAATACCAAGACTCGTCATTTGTC
ATTTGCCAAATTCAATTCTTCAGTCTTGGACAACTTTGATGTTATTGGTAGAGCAAAATTTCTGAGAACCTTCTTGTCCATTA
TCAATTTTGAAGCTGCTCCATTCAACAATGAGGAGGCACAATGTATCATAATGTCGAAGCTTATGTACTTGAGAGTTTTATC
ATTTTGTGACTTCCAAAGTCTGGATTCTTTGCCTGATTCAATAGGTAAATTGATCCATCTGCGCTATTTAGATCTCTCTTTTTC
AAGAATAGAAACACTGCCAAAGTCATTGTGTAATTTGTACAATCTGCAAACTTTGAAGTTGTGTAGTTGCAGAAAGCTGACT
AAGTTGCCCAGTGACATGCGCAATCTTGTTAACTTGCGTCATCTTGGTATTGCTTATACTCCTATAAAAGAGATGCCGAGAG
```

-continued

```
GAATGGGTAAATTAAATTAAATCATTTACAACATCTGGATTTCTTTGTTGTGGGCAAGCACGAAGAGAATGGAATCAAAGAATTGG
GAGGACTTTCAAATCTTCGTGGTCAGCTTGAAATTAGGAAGTTGGAGAATGTTTCCCAAAGTGATGAAGCGTTGGAGGCAA
GGATGATGGATAAAAAACACATTAATAGTTTACAGTTGGAATGGTCTGGATGTAACAACAACAGTACCAACTTCCAACTTG
AAATAGATGTGCTTTGCAAGTTACAGCCTCACTTTAACATTGAATCGTTGGAAATAAAAGGTTATGAAGGAACCAGATTTCC
AGATTGGATGGGAAATTCTTCCTACTGCAATATGATTAGTCTAAAATTGCGTGATTGTCACAACTGTAGTATGCTTCCTTCA
CTTGGACAACTACCTTCTCTCAAGGACCTTGGAATTGCACGATTGAATAGGCTGAAGACTATTGATGCAGGTTTCTACAAGA
ATGAAGAATGTCGTTCTGGGACGTCCTTTCCCTCCCTTGAATCTCTGTCCATTGATGACATGCCTTGTTGGGAGGTGTGGAG
TTCCTTCGATTCAGAAGCTTTTCCTGTGCTTAACAGTCTTGAAATACGTGACTGCCCCAAACTAGAGGGAAGTTTGCCGAAT
CACCTTCCTGCTCTGACAAAACTTGTGATTAGAAATTGCGAGCTGCTTGTCTCTTCTCTCCCAACGGCTCCCGCCATTCAAA
GTTTGGAGATATGTAAAAGCAATAAAGTAGCACTGCATGCGTTTCCTCTCTTGGTAGAAACTATAGAAGTAGAAGGAAGCC
CAATGGTGGAGTCCGTGATCGAGGCCATCACTAACATCCAACCAACTTGTCTCCGGTCTTTAACATTAAGGGATTGTTCGTC
AGCCGTGTCATTTCCGGGTGGTCGTTTACCTGAATCACTGAAGAGTCTGAGTATCAAGGATCTTAAAAAACTGGAATTCCCG
ACGCAACACAAACATGAGTTACTGGAAACACTGTCAATAGAAAGCAGTTGTGATTCACTCACATCTCTTCCATTGGTTACCT
TTCCAAATCTCAGATATCTCAGCATCGAAAAGTGTGAAAATATGGAATATCTTTTGGTTTCAGGGGAGAGTCATTTAAGAG
TCTGTGTTATTTGTTAATTTACAAATGCCCCAACTTTGTATCATTCTGGAGAGAAGGATTGCCTGCGCCCAACTTGATTACTT
TCAGTGTTTGGGCTCTGACAAGTTGAAGTCGTTGCCTGATGAGATGAGTACTCTTCTCCCAAAGTTAGAAGATCTCACCAT
ATCCAACTGCCCAGAAATTGAGTCCTTTCCAAAACGGGGTATGCCACCTAACCTGAGAAGAGTTGAGATTGTCAATTGTGA
GAAACTACTGAGCGGCCTAGCATGGCCATCCATGGGCATGCTTACTCATCTCAATGTTGGGGGTCCATGTGATGGCATCAA
GTCCTTCCCTAAAGAGGGTTTGCTGCCTCCCTCCCTTACGTCTCTGTCTCTATATGACTTGTCAAATCTGGAGATGTTGGACT
GCACGGGGCTTCTCCATCTCACATCCCTGCAACAATTACAAATTTTTGGATGTCCAAAGCTGGAGAATATGGCTGGAGAAA
GTCTTCCTTTCTCTCTAATAAAATTAACCATGGTGGAATGTCCTTTGCTGGAAAAACGATGCCGCATGAAGCACCCTCAAAT
TTGGCCTAAAGTTTCCCACATCCCTGGCATTAAGGTTGGCAATAGATGGATTTAGCCACCAAGGAGGACCAACAGGTATCT
TCTAAGTCTAACCAACTAGAAAACTATTTCTGTCAAGGATATGTTTCATTTCATGTCTTTCTACTTTTACGTTTTACTAAATC
CAATTCATTCTGAAATGGAAATTGACCTTGTATATATGTTACTGAATCTACAGAGAATCAACAAATCATCAAAGGCAACGT
GGAAATTGACCTTGTATATATGTTTCGAAGAAGTAACGATACAGGTACTAAGTAACAACATTGACAAATACTTAAATATAA
TGATTCTCCGGAAAAATGTTACACATCAGTGTTGTTATATTCTAACTTAATTTCTCCTTGATTATTGAGGCCAGAGTGAA
AATGACCGTGGGAAACTTATTTTTGTTTTTCAGATATGGTTGATTGGCCCGGAGAAACTGTACCTACCCATGAATCTAAGTT
CAAATTTGAACTAGTGCTAAATGTAACTTTTAATTTAATTGATGTCAAATTGACACTTTCTCAATAGCTGAATTTTTATTTGT
GAGGTTTTTCGTTGGGTACAATGTGAAGGATGAAAAGGTGTACCAAGTGAACTTTAGAAGGATTGGATGATTTCAGCTTATC
TCTTATTCCCTGTCCTATAAATTAATAATGGTATGATTATTCTAAAAATATGATAGATATGTAGATAAGTAAGAATTGATAA
AAGCATAATAAATATACAATTGCAATTCGGTAAACTGAAGAACATACATACTTCTTAGACATTGCTAAAAACAAAATCAAA
AAATTGTAGATCATTTTTTTCCTATTGTTCACAAATAAGAATGGTACTATCAATGATCAATCTCATTTCTTTCTTGAAATTAT
CTATAAACAAAACAATTTTCATATTGGTTCATCAAGAAACAATACTTTTTATATTTCTATATTATACTTACTTCTATGTTACA
TGTCACTATATTTGATTATCATAATTTTTTTTAAAGAATTGGTCACTTCACATATATGTATCAGATATATTGGTATCAGATA
TAGATGCATGAAGCAAATTAAAGTATCAGTACTTTGTAGCAAAACACATTCTTCAAATCATGACATGAGGTAAAAAAAAT
AAGATGATATTTTTGTAAGTATTGGAAAAAAAAGAGTAAAGCTTCTGAAATCAAAGAGACACTAATTTTCCACAACATCC
TTCAATTGGGCCCAAGCTTCCTTTCCTATGGACAAATAACTGGTTGTTAGTGCCAGCCTTTTCTTTTTACCAGTTTTCCATTG
ATGGTTAAAAGCTATTATGAACCTGTCACTCCTTAAAATTTCCACCAAAGTTTGGTAAATAAATATATAGGAGAGTGAATAA
TACAAGTCTTGCATTCTATCTCTAAGTTATTAGGTATATGAAACAGGTATGGGTATTTGGTTTTAGAAGGTATGTGGTTCATC
ACTATTTATATTATTACTACAAGAACCAGGTAAACTTTATTATGGTACAGTAAGTTTGGTGTGAGTTGTAACTACGTTATATC
```

-continued

```
CATCTCACTTAGCACGATAATTAAATTTAAAAGCAAAAAGATAAGAAAAAGGCCAATCTAACAATTGTTACCTCTCTTGCA
TGACAAAATCAGAAACAAAAGTCCCACTCTTTCCTCCATGGTGCCTGTAATTAACAAGCACTTCAAAAACCAATGTTAATT
AATTAATTTCCATAAAAAAAAAAAGGCAAAAGCCAATGAAATTTAAGGGGTACAACAAAGATTTGTAGAACGATCATTAAT
ATTAGTGCAACGCACCATGATGAAGTGCATGACATAATAATAATGTGGAACCAATCATGATAAGAACAGAAAATAAATCA
ATGCAATTGCATGATCAGAAAATAACGAGGCGATATATCATGTTCCTATTGATCAGACAATAGGACAACGTGTTAAAGAAA
TGTGTCAAGTGCAACAATGAGGGAACGGAGAAGAGAAGGATGATAAAGAATGTGGTTATGACTTCTACAAAGTCCAATTAT
TTACTTTTTTAATTTTTTATATTTTCCTTTTCACTTTCCTAATAGTTGTCGGATTAAAAGGAGTTTATGGAGTAGATTAGATTG
GTTTTGAAAAAGAGAAATATCATCTGATACAATTTTTAGTTTTCTTAATTTATTGTTCAATTGATGTAGTTTAAAAAGTTGCA
CTAACTGAAGTGGAAAAGGAACATAGGTTGGCATAATGGAATGGATAGCATTTGATCTTTAATAAATTTTTGCTTTGTGATA
GGTTCCTAATATTTAAAAAGTTTTGTTTGAAATACTTATCATTAGTCAAAATCCGTTATTTGCTCACACGATCGTTAACCAGC
CACACAGACATGTCATGTGTGATTTTTGTCTGACTGAGATTAGGACTAATGATAAGAAACTATAGTCAAAATCCTTTGGACA
TCAAAGAATCATTCTTCAGCAAATAACGGATTTTGACTAATGATAAGAAACTATAGTCAAAATCCCTTGGGCATCAAAAAA
TCACTCTTCAGCATTCCTCTACGTTTTCACACAACCCACTATAGTTTCTTCTATACCTTTCTTATGGATTTGTCACTATGACTT
CGTCACTCGTAAAGATCCAAGGTGAAGAGGTCCTCACCAACGATTTTTAGGACCTTGCAATCAATTTTGCATTTTCAAATCA
AACCAAGCCAATTCCCAACTCAAGAAATTCACATGGATAAGGTTTCTAAGAGAACACATCAAAATAGTTTCATGGGTAGAA
GAAGGTCAACAAAACCTTACCCTAAAATGTGATTCCGCTCGGTCCATTGAATAGAGCACGAAAAAATGAGTGGGATAGCG
ATGTCTGAACTTGTCGTCGACCTTTCATAGTTGCGAGCTCTTTTTGCAAACCCTTGCTTTCATGGTTGTCTCTTCTTGTTCTCC
CTTCTTAAAGGTCACCACCAACCCAGCCATCAGCCACCACTGGTGCTGCCAGTCGTGCCACTGCTCGTGCCAGGCGCCAGCT
ACCACCAGTAACTTCCTTCAACTCTCAAACCTCACTTCTCTCCCAGTCTCTCTCTCACACTTGGCCCTCCAACCCACTTGTGT
GTCGTAGGTGAAGAGAAGGAAATGATGAAAACAAAGAGGAGGGTTTTCTTTGGGGAAGGGGGTCCATGAGTGATTTTTGA
GAGAAGGAGATTTGTTGTTGCCATGGGAGCCATGGTTCAAGAGAAGAAAAAAAGAAATGGGTTAGAATTATTGTTGTGT
TGCTGCCATGGGGTTTCAAGGGAGGTTTGGGGGGTTTTGGAGACATAATAGCGGTGGTGTGGAGCTAGTGGAGGAGTTGGT
TGAGGACTGGTGGGGGTGGTTTGGAGGATTCGGGGACTTAATGATGTCGTTTTTTACTTTTTTCTATAAAAAAATAAAAAA
TCTTACGTGATCGGTTAACGATCACATATGAAGATAATGGATTTCGACTAACGGTAGGAACTTCGGACAAAGCTTTTTAAAT
ATTAGGGACCCATCATAAAGCAAAAATTTATTAGGGACCAAATGTAAAAAATGAGTATTTATCAGAGACCAAAAATATATT
TAAACCATTACCTAATTGCAACTCACTATGTGATAAGTTTGTTGACTTTTAAAATAATTATTTTAAAGTAATTCAAACAATAA
TTTATAATAGTGTAAAATCATTTTACATCATCAATACATAAGTATTAAACTCGATATCTCTCTATATATATTTTCTGTTCG
AGATTGATTGAAATTATCTTATTTGCTTAACATATTAAAATGCGTCATTTTTAATGATATTATTGGTCTATAGTTTTTATGTAA
TACATTTAATAATGTTTAGAAATATTTGTATATAAATAACTTTTATCTATTATTTCACCAGAGCCTATGAAATGTAAGCACAG
GTTTGTTAATGAGTAGCACAACATGGACAGTTTGTCAAAGGCCCAATAGCATCTTTAATGGGATTCTTGAACTCAAGAACTC
TATCCACTAGATCTACTATTATTCTTATTAAGAGTTTTTTAAGATGGAGATTGGGTTCTAGGAAAAGAACTCCTATTTTTTCA
AAAATATTATTTTTTCTTGTGCTAGTAAAATCTAATAATCCGAATTGGATTCTACTATTAGAATAAAAAATGATAGAAGTTC
GTGCATCCTATATAACATCATGGGACTCACAAAAAATAATCCAAGAACCTAAAATGGATTCTTTGACCAAAAATGTTCTAA
GAATCTCAATATTTTCCCACTTAAGAAATATAACTATCAAATCAATATAATATGAAATGAGTTCAATCTTTATTGATTCACTT
GACGCAAGCTATATGCACAACTGACATAATAGATTTTAATTCTAAATAACATGCAATAAAAATATAACAAACCTGTTCCGG
AAAAAGCCTCCTCAAAAAGAAGCACATTCGGTCCCCCCACAATTTTTACAAGTCGGGGTCTTTATGCTGCATCAAAATATT
CCATCATATCCCGCAAATGTTTCGTGCTATTAAGTTTATGTTAGTTGTCCCTTCATGATGCATCACCAGCATATCATAAACA
ATCAGTTAATCCCTTATTCTGCCGAAATAGTCGGATTATCGTCAATCCCCCTTAAGGTGGTCGTTTGATCCCGCTTGGCAAG
GCCCAACTTTGAAAGTGAATTGACCTAAGCCTCTTTTATGGGCTTGATGCGTGATAGAAGATCGGAACATAATCCAATACAT
TCCAATCTGAACCAAAACAAAACCTAAAACCAAACTACTAACTGATCTATAATTTTTTATACATCATAAAACTAAAAAAAC
```

-continued

```
AAAGCAAACTAAGCACATAATCTTACAATCCCTTCTGAATTTACTAAAAGAGACACAGATAGTTGAGGTGGGAAATGTTGC
CAAACCAGAAATGAATTATCACGCTCCAAATTAACTTTGGAAGCCAACCTGCACATACGTGTCTTCATGAAGAGTATGCTG
AAGCTGGATCCTCCAATCTTGCTCCAGCAGTGAGCTGATTAAGTTGATGAGGGTAGCATACGTGAGGATGAAACTTGTTGG
TTAATTACTTAATTTCTTCCTAGGACGAGTCTAAGAATCAGACTCAAACTAATAGAAGCCTAGATTCAAGGCATGACAGAG
ACCATAAAAGATGGCATGGAGTTCAGCCTTGAGATTGGTAGACACTCCACACGATCTTGATTTCATATTTTTTTCTTAAAA
TAACTACATACATATTAAGTAGCATGGTTTTAAATTATGATTGTGATTACTTTAAGGTGAGTCATAAAATCTTTTTATATATT
GCAGCTAATCACTGGAAAGTATGGCTGATGTGGTTACAATTAGGAGTCTTCTTAAAGCATTAATATTTTTTAACTTAACAAA
TATAATTAAAGAGAAGTAACTAATAAGATAATGATCTAAAATTCTTGTATTGATTGGAAATAGCGTAAAAAGATGTTTCAAA
TATAATGATACAAACTCTTTAAATGCAAATGGTTACATGCACAAAGCACGTGTATATATATGTATTCATACATACATACATA
TATATATATATATATATATATATATATATATATATATATATATATATATATATATATATATATATATATATATATATATATATATA
TATATATATATATATATATATATATATATATATATATATATATATATATATATATATATATATATATATATATATATATATATA
TATATATATATATTTGAATATATCTACGTACATTCATATATGTATGTATATGCAAACATATATACATCTGGATAGAGAGA
GGATCAGAATAGCAGGACAAAGACAAACTTGTATTTGTTGCTTCCATACTAGAATTGCATTTTCTTATATCAACTGTGTGGA
AGGGAAATTTATTAACAGCGCTAAGTATTCTCCTAACCTTAAGCAGGATCTCCTTCTGGTCTCTTGCCATCTGAGCTTGCAT
GTCAATGATGAAAAACCTGACAAGCGAGTCCGCAAGTGCCTCAAGTTGTTCCTGGTAACCAAGCTTTGTCACATTGACCAA
AAAACCAAGGTGACATTGACCAAAAAATAGTCCTGACAAGATGTTGGTAAAAAAATATAATCGGTTAATATCGATCACAA
ACATCATTGACTAAGGTTGACAAAAAAAATTTTAACCGACATTGATAAAAAAATAACTTCGACCAATGTCGATCAAAAGAA
ACATAACCGATTTCGGCCAACAGAAATATTTTATATGATAGCCTTTAGTTGCAAAAAGTGTGAACCAGGGGGTATTTTGACA
GCCGTAAAACATATCTCATGGCAGTGGTTGTTATATAAGGCAAAAAACCATGAACTTTCTTCTCTTGCTGGTGTTTAGCC
ACTTCAAATGTGATTGATGTTAGAGAAGTTAACAGTGGCATTTTTTAGGACTGAAAGTTAACTTAGGAGAAACCATTTTTTA
TGTATGTAATACGGTAACACATGTACCTCTTGCACAGATTGGGGAGAAATTGCAACTTTTTTTTACATTTTGCCTTAAAAA
AAGTGTTCATATTTATAAAAATAATTTTCTATTTAACTTGGATATTTTTCTTATACTACTACACTAAGGTATATACAACCTA
ATTAAGGCGTGTTTCTTAATTTGGAGACTGGTGCTTGATTGATTGACTACCAACGAAGGATAATCTAAAAAGGAGAAACAC
CATTTATAATCCTCATGAGTGCTTATGTCCCTTTTGCCTTGAGGTAGATGAGTCGGCATCTCACTGTTTCTTCTCATGTCATA
AAATTCTTGGTACTAATTTGGAGGCAATGTTACTCTTGGCTGCTGGCTGCATGTAAATGTGGTGTTGCCACAATGACCAGAA
TCACATTTTTGGCAAGATTCTGTATTCGTAAGTTCAAATTAAGAAGGAGGCAGATGTATGGAGGGCGGTGTGGGCATCAGA
AATTTTGGGGTGTATGGAATGCTAGGAATGAGTGTATGCTAAGGAATTAATGGCTCTTTCAATGCTGAGAAAATTACGCAG
AATATATTATTCTTTGCACGATCGTGGATTAATAAAAGCCAGAGTCCCTAATTTTAATTATTGTTTTACTTAATGATATATGG
CACCTGGAGCTTGTTTCATGAAGAGACAATTTTGAATGAAATGTGAAGTTAATTTGATTCGGTGGTAGCTGCTCTTCGAGTG
GGATCATCCCAAATGCAACCGATGTTTATGTGCACGATGGTGGGGGCTGGTTAGTGATGCGCATCAATGTTGCATGGCTTTA
GACATGATTTTAAATTGCAATTATGATTGCGTTGCTTGCAACGAACCTAAAAATCTTACATTGTGGATAATTATGGAAAAAT
ACAAACTGATGTGATCATAATTATAATTGTGATGTGATTACAGAGTCAAAATACATTAGCGTTATGACTGCAATTATGGTTG
CTGACTACAATTTAAAACCATGACTTTGGGTGTAATGGTCCATGTTCGATGCTAGCTATCTTTGTCGAGATAGAAATATAAT
CTAACCATGGAATTTGCTTTCTTTCTACTGTCACTGGTGTATATGTTTTTGGATCTTAGGTACTTTTGGTACCATTTAATACAA
ATCATTTTGTTGGAAAAAAAACTACGGTAGCCTACATGCAATATACAAAATAAAATTGAATTACTATATATTATCATAAATA
GTAGAGTATAAGAAGTAAAGAAAATTCTAAAGATAAACATGAATTTAAAAACATATGAAACTAATATATATATATATATAT
ATATATATATATAATAATAATAATAATAAGAGATTGTTTTCTATATATATAACATATTTAATTAGCTTAATAGAAATGCG
AAAGTACAATAAAAAAGCAAAAACATAATAGGCGTGACAAATCGGTTGCTAATATACAATAAAGACAACAAAGTTTGAAA
CTAAAACCTTATCCAGACTATCCAAATAACCCTAATTAATCATGCAAAAATTAGAACAGAAGAAATTTAATAACTATAGCA
ACAGTAACAGCAGCAGCTATAGCTAATGCCGCGATCACCGAATCGGAACTTTTCATCATTGAAGTATTCTATTTCACTAA
```

-continued

```
CCCTAAGCAAGATCTCAAGTTGATCGCGTGCAATAAGAGCTAGCATTTCAATATTGAAAAACCTCTCAATTGAGTCTGCAA
GATCTTTAATTTTAGTTATCCACGGTAAGAATTATTAGCCACAAAATTGTATTTCCCTATTTTTGAACACTTGTAAACAACCT
CTTTGCTCTTCCTCAATAGTTGTATCAGTGGCTCAAGTTCCTGCTGTGAACGGCCCAACATATTCCTGTACTTACCTATCTCC
TGCCATGTTTACCGCTACATATTTTCTAGAATGTTATTTGAATTTCATTAAAAATCATAAGAAGCAAGTTTGAATTTTTCAGT
GAAATTTTTACTTAGGTTTAGTTAGAAAACCCTATTTAAAAGCTATATTGTTTTGCTTATCGAAACAAAACCAATTAGTTCGG
TTTGAATTTCTTAGTTAATAAATCAATTTTATATGATTTTTTATACAAAATATTAAACTCAATTTACTAAATAAGATTTATATC
AAATTCATGAAGGTAAAAGTAATATTTTTATCTTTTAATGTAAGGCTTGGTTTCACTTTTGTCCTTTAACTTTTTTTATTTGA
TTTATTTCAGTTATCATTTAATATTTATGGGTTCTTCCTTAAGGAATCTTGATTTTCCTATAGTTTTAATTGTTCTTCGGTTATT
TATTCCGAAATTGAGAGGGGATCATCACCTCCAAAGATTTCCTCGCTCCCATTAACAAAAATGTCTAAACAATTACCTTCCT
TCTAAAAAATTTGTAAAGTACCTCCACTAATTAAACTCAACATATTCTCCCATACTTCATTTTCTTTGAAAACAATGTTGTCT
AATTCAAGACGCTTCGATATAAAATATTTAGTCGCTAGAACGAGAGAAAAAAAATTGAATAAAAAGAAGGGATTTTTTTTT
TCTTCTTAACGTACTTCATGCTACTTATTTGCTGGCAATCATTATTAATATATATTATCTTATATGAGACAATTTTGAACATTT
AAATGTTAATTTTGTAAGTATCTTGGTAGTATCCTTTTCTGATAAGGAATAGATATTATTTTGAGATTATATTATGATGATGA
ATTGTCTCATAAAAACACGAGGCAAGCACTTGAAAGGAACAAATTCTCTAATTTCTTAGTGGGTAGTGGGAGAGAGGAAGT
AAACTTGCTTCAATAGGCAAATGACGCATGACGCACTCTTTATAGGAGAAGCAACACTTTCTAAGGTGCTTACCATAAAAA
GCATTTTGAGAGGCTTTGAACTTGTCTCGGGCCTCAAAATGAATTTCCATCAAAGCTTTTGTGGTGCCTTGGGAGTGGATAT
TGATACCTTGATGAATTATGCAAGCTTGCTTATTTACTTGAGACAGACTATATATGCACAACTGACAAAATAGACTTTAATT
CTAAATAGCAATAAAAAGATATATAATAAACCTGTTTGAAAACGGAGGCTACTTCAATCTAGTACGGTAGTTGACTTACTA
AGTACGAAACAACAAATTAATGAGACTGCTGACTACTGATTTCATAGAAAGATTTAGGAAGATGAGGAGTAAGAAATGTAT
GGTAAAGCTTCTAGGAGTAGAATATGTTACTATGTCTTAAAGTAAAAAAATATTTATGTTTAAAAGATGAATTATGATTCAT
AATTATTTTAATTAAATATAAATAATAAAAGTTATATATAATATATTATTGGATCATAATTTATAATTTTATGTTTGTATTTTC
AGTCAATACATTTATAAAACAATTTAGCATAACATTTATGAACTAAATTTAAAACCTTTATTTAATATTTTAAGATTCTTTCA
TTAGAAACAAGTTCCGGTATAGGAGTTGGTATCCTTTCAAATGATATAAAGCAATAGATTTAAATTTTATATTCTATTTTATT
GTGTCAAAATAATGTATTAAATTCTTTGGTAAGAGACACTATAATTTTAAGTTATTAAGTTGATAATTAATTAAACATGATTT
TAAATACTTACATATTTATTCACTTATAACTATAAAGATTTAGTAAGAGCATAAATAAAAAATGTTGTTATAATATATAATTT
TAAATTTAATATAATAAAAATGTGTTAGCAAAATAGAAATATAAACATAAAGCGTGACAACACATGTTTTTAGTTAATAATA
ATAATAATATTAATTACAAATATTAAATAGGTTTTGACAAAATCATACCTGGCGCAAATATGCAGTTTAGTGACGGAATTAA
TTTGTGATTCATGCAATACAATTTGTACCAATCATCATCATCATCATAATCTCTTTTTCGTTTTATTTATCAATGTTGCTACTT
AGTACGAAAATTATTTGCACAAAATACAAACAGAATGATGCTATCTGTTATGAAAAGTAAATCCACACGAATTACACGAA
ACATAGAATGGACGGTTATGATTTTATAAAATGAATATCGATTAAATTTAAATGTTATGGTAATTTTAAAATATGAATGATA
AAATGATTCAATTATTATACTTTAGTTTGTAAATAAAAATTGATTTTTATAATATTTAAAGTTTATAAATAATATTTTGAATA
ATTTTAAAAATAAATTAATTAAATTAAATGCAAAAAACTGAAATTAAATATTGCTTAAAACTAATTAATTATTATTATATCA
TCTGCTCCATTATAATTGTTGTGTAAAAAATAATAATTCTAAAATAATTTTTATTTTTATTTTTAATGTAAAATTAATTATGT
TTTTTTACTTATATTTCTTATATATGAATGATGAACTACAAAATTTAAAAATAAATTATTGATGATATAAAGTTAATTTTATA
AAATTATTTTTTATTTTTTATTTATATAAAATAATGTATGATGATAATTATTTTCAGAAGAAAAGCAACACTTTTCTAAGAT
AAATTGTTATAGATGTTTAATATTATATTTTGCTTGTAAGACAAAAACATACTAACTACTAAATTATCTAATTTATGTATATT
TTTAGTCCTTTGCATAATCGGGCGATAACTTATCATATGAAAGAATACTGATGATGATAAATACTTTTTGAAGAATAATAAT
TTTTATGAAATATTTGAATTAGTTTTACATTAAGAGTTTCTAATGATCTTAAAATGATTAAATGTATTATATTATATTTAGTAA
TATACTTAAAAATTTAAATATTGTTGTAATTTTAAAATATGAAAGGATAAAATAATTGAATTATTTTACAATGGTATTTCAAA
CAAAAATAAATAGTTATACTTTTTTTTTATAATACTAGTATATGTATAAAATAGAAGAAGATAGATAAATAATACAAGTTAT
```

-continued

```
ATCCAATTACTACAAGTACGCACCGATCAATTTCAATAAAAAAAAAAAACAAGGTGTGAGTGAAGTCAACAATTAAGATAG
AAATGAAGTTGGAAGAATCATCGATTTTAAGATTGCATTATATGCTAATAATTGGGCTGACTATATATACCCAACAATTAAT
GTTGTTATCGTTGTTGTGCTTGTCTAGTGAATGATGGCAGATGTTGTATTTCAAGGTATGGGAACTGCGTGGCAATTTCTGAA
CGTGATTATGGTCATAAAAGACAAAGTTACGTTCAAAACAGCATTGGAAAACCTCCAATCCATTCTAATACGCAGCTTGTTT
CTGATTGTTCCAAAGTCCACAGCTTAAATTTTGTGGCCAGGCATCGTTACAATGTTAAACTAAAGGCATTTACAAAGTCATT
TCGGAATATTTACTCCACGGTCATGTTAGCTCAGATTGCAAGAGATCAAAAAGAGAACCGTAGGAGTCAAATACTACTTGC
CTACAATAATCCTGCTCAGTCTCATAAGATTCTAAGTATTGTTGATATATATTAATATTAAGGGTCTATCTGGATAAATGTAT
TTAGAAGTACTACTAAAAAAATCCATCTCAAAGCAGAAAACGCCCTTATTAGCTTCACAGCAAAGACAGAAATCCACGTCA
AAAACATTAACAACGTGTTTTCAATTGCCTCCCCAGGGTCGAAGCACGTTTTCTCAACAACCCTAAGCAATGTCTCCTCTGA
TCTCTTGCCATCTGAGCTTGCATGTCGATGGCAAATAGTTTCCCGAGCTCGTCGAAAAACCGGTCCAGTTTGTCCTTGTAAC
AAGCCCTAGTCACAAAGTGTAGCCACCGGATTTTTGAACACTCGAAAACAAGCTGTGTCCCCTCCTCCATCTTTCTGATAAA
CGATTGGAGTTCCTCCTTCGGAAGCTGCAACTCGTTGTTTTTCTGTTCTATCTCCTTGATCACCGGAGATATAGCTACTAGAG
TGGATATTGGAGGTGCACCAAAGATGATTTGAAGCAAACCGTTTTGTTTTTAAGTTCCAAAACGGTTCCCAGCAACTCGTTG
AACACAGCTCCCACTGTTGCTTCTATTAGTAGTGCCATGATATTCACAACAGAAACACGCACCCACAAGGATGAAAACAAG
ATGAAGAAATAAACCTCTCTTTATAATATATAGAGTCAGGTTAAACGTAATGTTAAAAAGGAAGTTTCTTGGAACTCCATTT
CTATCCTGTTGACTTTACGAACTTGTAGCTAGGTATACTTGTTTGTATTATTTACCGACTTGAACATATTTTAATTATTTATTT
AATTAACTGAATAGTTATAATTTCCTTAATAGATGCGAGATGCCAAATCTTGTTCCACCCTCCAACCCCAAGGATAATTAAT
AGTTAAGTGTGAAATAGTATGTGTGTCTATCTATATATATATTATAAAATTTTTTATACAATTATCTAATTATAACATATT
ATTTATGTGAGAAATTTATTAATTTTTAAATAATTCAAATGATAATTTATAATCAGATGACCGTGTCAAATTATTTTATACC
ATCAATGAATAAACATTAATCTCTCTCTCTCTCTCTCTCTATATATATATATAAATTCTAATCAAGGTTGGTTGAAATT
ATCTTACACTAAAACTACCATTATTCTTATTCAAGAGTATTTCATGATGAAGGTTGGATTTTAGGAGAAAAATTCCTAAAAA
TTCCTTTTTTTTTTGTGCAAGTAAAATCTAAGAATTCAAATTGAATTTTATCATTGGAGCAAAAAATGATAGAAGTTGTTGC
ATTCTATATAGCATCATATGACCCATAAAAAATAATCCAAGAATCCAAAAAGGATTCTTTAACCAAAGATGCTCTAAGAAT
CTCAATATTTTCTCACTTAAGAAACATAACTATCAAATTAATATACTATGAAACGAGTTTAATCTTTAGTGATTTACTTGAGA
CAAACTATATGCACTACTGGCATAATAGACTTTAATTCTAAAGAACAATACAAAGACAACAAACATGTTCCGGAAAAAAGC
TTCCTCAAAATGGAGGCTACTTCAATTTAGAACACTCACGTGAAGTGTATTGTATAACATGTCTCCTTAGGTCAGAATGAGA
GCTTTTTATTCGTGCTTGAAGCACGCCCCCTTCAATTTTTACAAGTCGAGGTCTTTATGTTGTATCAAAATGTTCAATCATAT
CCAGCTAATGTTGTCGTGCAATTAACTTTATGATAGTTGTCCCTTCATGATGACTAACTGTCGTACCATAAACAATTCATTA
ATCCCTTACTTTTGCTAGCGAGAAAATTGTTGCTGCAGTCCACTGTAATATCATTTGTTGCAAAAAATTTTGCAACGATATTT
AATGTCACTACCACTCTTAACGCTTTCGCAACAAAAACTTCTACTATTTGATAACTACGAAAATTAGGCTTAATTGATAGTC
AAATTTAACTAAAAATGATTAGAATTTCTTTATTTTATTATTATTTTTAATAGAATAATGAGGATTTTAATATCATTTTAATTC
TTCTTTCAAGTTTTTAATTTCTCCTCCTCAGTAATCTAGATTCCATAAGATACTTCTTGAAGTGCAGCTATGATTTTTTTTTT
TTGTATTTTTACCATTCTTTTCTTAAAATTATCATACATAATTATATATGCTATATACTTGTTGTTAGGGAAGAAGATAAAAGT
TGGTTTTCGAGGATCAGGGCCTCCACTGAGAAAAGGATAAGGGAAGGAACAGTTGTATATTCCATTGATTGATGCTGTTATT
ACATAATATTATTTATACTGATTTCTCAATAATCAAATTTGTCTTTTTGTGCTACAGAATATCAGCAAATGGTTAAGTTTGTC
TACCCCTACAGTACAGTGGCGGATTCAAGATCCTAAGTCAGTTGGTACAAATTATAAAAAATAAAATCAGTGGGTTCAATT
ATATAAATATAGATGAAATAAAATATAAAAATATAAGATTTTATTTACAAATTTGGTGAATTTTAAAAAATGAGGGGATGCA
AGTGCACACCCTCAGATGGCTGTAGGTCCGTCATTGCTTCCAGATATGGTGCACCTGCTTGCAATCCTTGAGCTAAGTGGGC
CTTGTAATTGCTCTCTTGGTCTTGTTTTCTAATTGCACCCTTTTCTGTTGCTTGCTTGCTGCATTCTCATCCTCTGTTTCTGCA
ACTGGTTCCTTTGCTACGCTATCACTTGTGGTGCCGTTTTTGGCTTTTCCAGTCTTCCCAAGTTCCCACTGATTCAAATTCCA
```

-continued

```
AAAGTTCTGCAAATAAAATTGAAGAAGAAGCTAGAGGTGGGAAATACTTAAGTCATTCTCTTGAAAAAGTTGCAGCAATGA

TATGCAACAAAATATCACTATACCGAGTCAAGGTAATTATTGTGTTCACATGAACATTTCTCCCATGAAAATATATATTTTC

TGACTTTGTAATCTCTTTATAGTATGCATGGAAAAATAATTTTCTGATTTTTTTCTCTGTAGTGTTATATATTATTTTTAATC

ACATTTTCTTATTTATTTAGTTTGTTTCTGATTTGACATCATGTGAATTTGGAGATTTGGGTTAGAAATATTTTTGGAATTTTC

CTGGTTAGAACTTGATAGGTCCATAATGAAGGTATATAAAAGGATAGGGAAAAGAGGGAGAGCGGAATAGAAAAAGAAAG

GACAAATGGGCCTCAAAAACAAGACATGCTTGTGTATGACAGCAGAAAGAATCAGCAGTACAAGTTGCACTAGCTGAAGT

GGAAAAGGAACATAGGTTGACATAATGGAATGGATAGCTTGTAAGGAGAGTGTACGTAGAGGCTGAGAATAAGTTCTTCCT

TAAGAAAGGGAGTGGGTCTGGGTTTGTTTTTTCCTAATTACCATTCTCAACATCTGGCTTGTATCCGCCACTCCCCTTCTCTC

TGAGTTCTATTTTTCATACTTGGAAGCCTATTTTTTTTAATATAAATATAAAATTATGGGGATATCTACCTGTCAAAACTTAA

TATAATATATTAGTATCTATTATTTATTTATTTTTATTGATTTTATTTAGTAAAAATCACCCACTTTTCTTTTCCGCATACATCTT

TGACATATATGTAAGGACATTGAAATCTTTAATTCATTAATATATGTTTTTAGGAATAAATTAACATGTGTTCTTTCTTTAAT

TCTATGCGTATGGGTTAACCAATATTCAAACTCTAGACCATTTAGTTAAAAAATACAAGTCATTACTATTTGTGTCAATCAT

TATTGGTACACTGCACAAGTTTAAAATCTAGTTAGATTTGTAAAGAAATGTTATGTTACATTTCAAATGACTTCTGACTTTCT

TTAGTAGCTAAAAAACTTGTTTAACTATTTGATAAACAAGTTTTTTCAATAATTTTTAACATTTTTTAAAACGTTACTTAAAT

TAATATTTTTAAAAATACTAGTTTCTAACATTTTATATTTTTTCTTATTTTATCTTTAATATATAAACTTAAATCTTGAATTA

GTTAGATACAAGACTATATCCAATCCCACTTAACTAACCTCAAGAAATTAGATGTCTTATATAATTATTAAATTTATTTAAT

ACACGTCTTTCATTTTGTAATGATAAAAGATTTACTGATAATAATGCATTCCTTTTATAGTATTAATTATTTTATTTCTATTAT

GACATTATTTTCTTACTCTAATTTTTAAATATTTTTACTTCATAATAAATATAAGAAATGTAATATCAAATATTATATTAAAA

TTAAAATAATTTTAATACGAATAAAACAATTAATCATATTTCTAATTTATGCGTTATGTTTTAAGCTGAAAAATAAAATTAA

CTGTAAAGATTTGGGTTTAGTTAAATTTATTCGTAATTGACTTTAGAAGGAGTAAATTGAAATACACTTTTAAATTAATATTT

GAGTTTCTCTATCAAAAAAGGCTATTTGAGTTTTATATTTTTATTCCGACGTCAAATTCTTTGATATGTATAGACTATATTTG

AGATACTTTTCGCTTTGAATTTCTATCACGCTCTGAGAAATCAAATATATATATATTTCTCTTGATCTTAACTTTAAAGTTTA

AAGTGATATGAGATTTTTACACATACTAAAACAATTTTTTCTCAAATATGCATCCATTGATATCCTTGTCTTTGGGTTTGGAT

CCAAGAGTTTCGACAGCAATCTGCGTACATCTGGTGCAATCCAGTTAGGAAATTTGAACTCTCCCCTGCCAATAGAACATA

CAAGATCATAACTCCTTCTGTTTATCACTTCCGGAGCAGCATAGGCAGGGCACCACATGTAGTGTGGAGTAATCCATTTAT

ATTCCCATTTTCATCCAGTAGAAGATTTTCTGGTTTCAGATCACGATGGCACACACCTCGGCTATGGCAGTAGTCAACAGCG

CTGATCAATTGCTGAAATTATCTCCTAGCATCATCCTGCTTGAGCTTTCCTTTGGATACCTTATTGAAGAGCTCACCACCTTT

TACATACTCCATAACAAAGTAAATTTTGGTTTTGCTGGCCATTACCTCGTAAAGCTCAACCACATGTGGATGCCTGGTTAGC

CTCATCGCTGAAATTTCGCGCTTAATCTGATCAATCATCCCAACTTTCAGAATCTTCTCCTTGTCAGTAATCTTAATGGCCAC

ACTCATGCCAGTTATGATGTTCCTAGCATGGTAGACTTTTGCAAAGGTTGAACAAGGATAGCTCAGATGGAGGCACGGACT

CATCAACCTCGGTGAAGGAATTCTTAACTGTCAAGCACATCTTTCACCATTCCCTGATTTTGGTGATGACACTAGAGAACAA

TGAAGAATATGGACTTCTTGGAAAGTTTGAAGAATAATTAAGGAATGATGCAGCACCTGGTTAGCCTTCCAATTACCCAGC

AGCAGAATATACAATGAAAGACACACCTGAAAGAAAGATGAACAAATTTAATAAGTTGGGATCATTGTCAGAGAATATAA

TCTCCTGAATAAAATTCTTGAAACTTCTACAAACATAACCAGCATAACAATTTTTATAACTTGTTTCTGATGTCATTTTTGAA

CAATCCCAAAACCATAAGGCATTAGGTGAGTTTTGATCATATTTAAACAGGACTGGATTAAAAAACAAAGTATTTAGCACA

TCAATTACATTTCTCTCAGGTAGTCTAGTCGTTTTTAGAGTTCTTATAAATAAACGATTCATGACCAAGAAGAACAACACAA

GACTAAACAAGTATGACAGAAATGTAAGATTGTCAAAAATCAAGAATAAATCGAAACCAGAGATGGCCACACATTATGCA

GAAGAAATAAAATTTAATCAAACAATCAATCAGCAGATGGCAGAAAGCACACTAATACAACAAAATACATCAATAATGAA

CTTGAGATTCATAAAAAAGGAGCATGCAAACAAGTGAGACCTGCATTCTGTTTTGAATTACATAGACAAATCAAGTCATTC

ACACTCATCTGCCCAAATTAATCGTCTAAAGTTGGGAGAGTTTAATGACACTCGAGAAGAAAATGAAAATTCAGTAAGGTT
```

-continued

TCAAATAAGCAAGTATAAATATAACTGAGTTGCCACCGTTTTCAGATGAATGTGGTTCCACTTTCCATTACAATCGTTACCG

TTTGGCAGTCTATCTACCAATTTTCATGCTTGGGTCACATGCACTAAGTTATTGTCAATACATATTGGCAACAAATTAAAATT

TTCCAGATGAAAAAAAAAGGAAAAAAATTTACAAATTTGCCGATAAGAGAAAAAGGCAAATAAACACAAACACCCCTCTCA

CCAAGAGAGAGCTTAACTCATGAAAATAACAACCATCCACCTATACCAGAATTTGGTTTTAAAATATCATAATTTTGTACTG

TTTATTTTTAAACATGTTATTATTTGTAAAAATTGACCAAAGGTGCACTTAGATCTTCTCATGCTACACAAAAATCAAGTTTA

ATAAACATTAAGAAATATTTGTTACATTTAATAAGGGAGATTTTCATAATAAAAAAAATTCTGAATTTCAATAAAAATACAT

TTGATGATCTATTTTTTGTAGTATAAAATCTTTGTATAACATTAGAAATTATGAAATGTAAAGTCATAAAAAGGAATATTGAT

ATACTCTATATTGTTTCTAAGTTTTTTACTATCCACTTTGTAGTAGTATTGAATAAGTAAAATTCTATCAAAATCTTTCACAC

AAATAAAATCAGGTGAAATCTCAATATTATGATTGGGCAAGATTTCCCTCATGAATGATAGAATCTGAATTTTATTTGATTC

TTGCTTGCTGGTTGATTTTTTCTTAAGAATTTAACAAATATATCTTTTATATATATATATATATATATATATATATATATATAT

ATATATATATATATATATATATATATATGCATATATATACTTATATTAGATACATTAAATTTCAAATTTCTGTAACAACCT

TTGTGAATTATAAGGAAAGTCTGGTCAACTAAATAAGCTAATTTACACTCATGCATACAATCGCTTCACTTGAACTTAACTC

AATCGTCATCATCATTATTATAGTGAGTTAATAGAAATGCAAGATTCTCATTACTAAAAAAAAATAGTCATTACTAAAAAAA

ATAGTCATTCCATAAAAAAATAGCTATAAGAGGTCTTGTTAATAAATATTCTTAAATACTAAGAAAACTTAAAAATATTAAA

TAAAAATATAATATTAGTATATTAAAATTGTTTGAAATTTAATTTATTATTCAAACAATTTGCTTTTTTAAAAATCTTAACAA

TTTCACTTGTTACAATGTGACAAAACATTCAAGGAAGAAAAAACAAAGTTAACTTATATGTGGGGAGTGAGAAATACGACA

ACAAATGACGCTATAAAAGTAATATATTGTTGATAAATAGAAAAAATAAGTCCTCTAATAAAATTGGTAAAACAAAATTAA

AACTTCATTCAATAATATTTTATCATCTATAATAATTATGATAATTACTCTTAAAATCATCTCTACGATGATCTCTGAGGGAA

TGAAAATATAAAATAAATTTCC

>BAC99.FASTA.SCREEN.CONTIG1 (SEQ ID NO:177)
GACCGCTGGGATANGATCCGNCNCTCGTGTGAATNCAAAATCCGTNCCCGGGGATCAGGCAAAAGTTCCAAAAAATCACA

GGTCTGCTTTTCTCAAAGAAATCGGAGGAAAGCGAGAAAAGAGAAAAATGATATGAATACCGAAGAACTCACTAACGATT

GTTGCTTTTTCTCAAATAGTGATTATGTCTTTGGCAACTGTTCTTGCGGCCATGTCCTCCCTTTGGAGTCTAATTTTGATCTTC

GAACGTTTAAGTTTTCGACATAGGGTTGGGTGGAGCTTGTTCGCACGATGAAGCAAAATGGGAAAGCTTTTGTTTCGATTGT

GGGAACACTGGTAAGCGAAATGAACTGGTTTTGAAAAGGGGAAAATAATGGCCTTAATTAGGGATTGGAAGTGGAAAGA

ATAAAACTTGATAGAGAAGCACCATATCCACTAAAAAAGGGGTCTCGATGTTGTAAGAAGTCGGTGGGTCTTTCTACAAGT

CCTTGAGCTCCTTGAGGATGCGCTTTGAAGCCATGGGAGGGACGATTCGCATTCAGATCTGGATATCATGTCTTGGTTGTGC

AGCCCCGATTACCGCAGTCCCCGAAAGATGGATCTGAAAGGGAAAGAGGGACATAGCGCGAGCGAGAGGTCTCTGTGGCC

TCTCCCTGCTGGTTATCGAAATACCCATTGATGGACAACAAATGCTTTGACTCTCCCCGAGGGCGCTTTTTTCCTAAAAAGC

TTTTCCTCTCCGAAGACCGCTTTTTCACTACGGTTTCCGCCCAACCCCCCGGGGAATGGCCACTCCCCAACATCCCACGTTT

CCCATAATTGCCCCTGGCCGTTCCCACCTACAATGGGCCCCCTTTGCGGAACCGGCCTCGTTTTTCACAAACTTAAAAAACG

GCCTTTACCCTC

>BAC99.FASTA.SCREEN.CONTIG2 (SEQ ID NO:178)
TGACAATAGCCCAAACACAAACACACACTAGGAATGAGTTATCACATTCATATATAATAAAATATTAGAGCATGTAAAACA

TATAATACTTAAAGCTGAATTTATATAATTAACATCACTTCCCAAAATCACACACATTTTGCACATCCATTCAAGTTCATCC

ACTCCAGAAAATAACATCAAACCACAATTGTTAACTCAATGAAAGTCAAACACATGCATTATGCAACAAATACTCTAGACT

TAAGCCTACATGCAATGTGGTACCATTTTTCAGTGAAAAACCTCGTTGGGCGCCTAAGAGTACATGACAGGACATGCCTCA

CAATGGGTAAGTTAGGTCACTTTCACTAAGTGAAATCATAGGGAGACCAGTCAGGATCACGTTGTTTTGCGAGAATGCTCC

AACCATGTGGGAGCGGCACAGGCTTAAAGGAGCACTCAAATCGGATGACCCCCAAGGCCTACACTCCGAAGAGTTCGTCA

GGGCCTCTCCCTCCTGATTCAGGTCTAACCCAAAAAAAAATTTGAACACATAGACTCTACCTATGAATTATGCAATGCACA

-continued

CAACTACTCAATTGTGTGTGTGTATATATATATATATATATATATATATATATATATATATATATATATATATGT

ATGTATGTATATTTTTAAAATATATTTTAACTCAGTGCACCTCAAGGTATTAACTCGTCGGGTTCCCGCAGTGGATCCTCA

AG

>BAC99.FASTA.SCREEN.CONTIG3 (SEQ ID NO:179)
ACCACTTAAGTAAAAAAGAATCACTTGATAAGAAAGAACTACGTAGGTCTGATTTTCTCATCCCAAATTGAGGAATACGTA

GGAGCAAAGGGAAACACCCTTGTCGACCACAAAAAAGGAAAAAATATAAAAAGGGTATAAAGGATATAAGAACATAAAA

GGGAATAAAAAAATCAAAGTCATGTTTGCACATTCGATTAAAGGCTGCCGTCCCTTGGGACGGGCGTGTGGGGTGCTAATA

CCTTCCCCGTGCGTAAATACAACTCCCGAACCTTTCAAACTTAAAAATTCGTAGATCGCGTTTTCCGGTTTTTCCGACGTT

TTCCTCAAATAAACGTTGGTGGCGACTCCGCACGTATTCCTTTCGTGGAACACGCATCCCGCGAGTCACGCGTCGCCCTCCC

GCCGAAGGGTAGGTTGCGACAGTTGGCGACTCCACTGGGGACCTGTTTTAGAGAGTTAGGCCATTTAATCTTGTGCAATGTT

TTATCATGACTTTCTCCTTTGTTGGTTTCCCTTTATTTGTCTTATGTTCTTGTGTATATAAACTATTTGTTGCTTTTAGTGTATT

TTAAAATGTATGCATGAGGTAAATATTTATTCATTTGATGCACACAAACACCAACACTATTTGCACACACTGTGAGTGAAAA

AAAAAGGGCCCTATACCCGGGTTCGTGGGAACATAAGGAGTGGAGGTGAATCTGTGATCATGCTAGGTCTCCGACTTGCTT

GATTACAGTGAACCCTCATCTAGAGCTTTTCTCTTTGAAAACCTATTGTTGCTAGTAGTCCCTACTGCTACGATATGTTCTTC

AAAGGGGATGATACCTCTAGAAACCATCAAGAGAGATATAACTACCTTGGGGATTATTGCTAAAAGCCTAGTTAGTTCTCT

CCCTTATAGGTCCTTTAAATAGGGGCACGAAGCAAACACGCTGCGTGCCATTTTTCACACTGCCATGCATGAGTATCATATA

CCCTTTTGCTTATGTTCAGTAAATATTGTCATACTGTGTACGTTCCCGCATTGTGTCTTTTGCATAAGCATTGCATACGGATT

CTTTCTTGATCCCTACTGTAAACAAACCAACGGAGGGTCCGTGTCGCCTTCTTAAAAACGTGCGTTGGCGGCATTTTGCTAC

CCCTAGACGTCGTATCTAAGAAGGGGACAAATTCCCCGGACCCCCGCATTCCTAGATTGCATCTGTGTCATATGCACTCCAT

CATGCATTCATCCATTCCACCCATGAGATATCGGAGTTTTGATTTGCACCAGCTTTTATCTCACTTTAGTAAGCATGGGAAC

AAATCAAACCGGCAAGAGGTTTTACCAAGTCAAGGTCAAAAGCCCAGATACCACCAGCATCAAGGAATTAGGGCGGTTGA

TGGAACCCCTCCAAATGCAAGCCTTCCGCAAGACTTACGGAAAGATCTTAGAGTTGACCATAGCAGAGGTGTCCATAGAAG

CCATTGCATCACTTACCCAATACTACGACCAGCCCTTGAGATGCTTCACATTCGGGGACTTCCAATTAGTACCAACCATTGA

AGAATTTGAGGAAATTCTAGGATGTCCTCTCGGGGGAAGGAAACCATATCTTCCCTCCGGGTGTCTCCCCTCTTTGAGCAGA

ATTGCAACTGTGGTCAAGGATTCAGCCAGAGGTTTGGACCGCATAAAACAGACTCGGACGGATAGCGGGCCTGCCACA

GAAGTACCTAGAAGACAAGGCGAGGGGTATGGCCAATCAAGGAGACTGGGTCCCGTTTATGGATGTGTTAGCTTTGCTAAT

TTTTGGGGTCACCCTCTTTCCAAACGTGGATGGTTTGATAGACCTAGCAGCAATCGACGCTTTCCTTGCCTACCACCATAGC

AAGGAAAGTCCGGTGGTAGCCGTCTTGGCAGATCTATTTGACACATTTGACCGAAGGTGCGAAAAGAGTAGCGCACGGATC

ATCTGTTGCTTACCCGCCCTCTGTGTTTGGTTGGTTTCACACTTGTTCCAACAAGACACAAGACATCCATGTCCGCTCCTGA

GCCATCGCTCATGTACTGAAAAGAGGAGAATAGATTGGGACCAGCTCTTGGCCGGGATAGGAGGTAGAACAATCAGTTGGT

TCCCCCGATGGAAGGAAGGAAAAGAAGGAGTCCTTTCCTCGTGTGGAAGATACCCAAACATTCCGCTGGTAGGGACGAGG

GGTTGTATTAATTACAATCCCACGCTCGCTATAAGACAACTAGGGTACCCCATGAGGGGAGCACCGACGGAAGAAAGCAT

GTCTCCTTTCCTTGTGAGGGATCTCGGCGCACAAAATTCCAAGACTATACAAAGAATCCATAAAGCATGGGAAACCCCGTT

AAGGAAAGATCAAGAGCTTAGAGGCATTCGTAATGGCATCATTGGTGGGTACCACCAATGGCTGAAAGTTCGCATACGAGG

TTTAGATTGGCTCGCCAAGTTAAAAGTCGTCAGCGAAGAGAATTTTGAAGCACCGGAAGCGGATGAAGAAGTCCAAGCTCT

CAAAAGCGAGTTAGGAAAGGCAAAACTCGCCAAGGAGAAGTTCAAGTTGGCTGCTACACACGTTCGGAAGGAGTGTGCCG

GGTTACGGGAAGAGAATGCAATTACCGCAAGGGCCCTTGAACAAGAGACCAAGAGGGCTCGCAGGGAAGAGTATGGCCGG

AACAAATTTCGCGGAGCTCTATGGGGTAGCAATAATGAACTCAAGTTGCGAAGGGAAGAAAGGGACCAGTCGCGAGCACA

TAGCATGGTTCTGAAAGAGGAGTTGATTACTTGTTCAAGGTCCAAAAGAAGCTTGTCTCAGCGTCTATGCGAGACAGAAAC

CAACATGTTAGCTATCATCGCCAAGTACCAAGAAGAGTTGGGTCTAGCCACGGCCCACGAGCATAGAATCGCGGATGAGTA

-continued

```
TGCCCAAGTATATGCGGAAAAAGAGGCTAGAGGAAGGGTGATCGACTCTTTACACCAAGAGGCAACCATGTGGATGGATC

AGTTTGCTCTTACCTTGAACGGGAGTCAAGAACTTCCCCGATTGTTAGCCAAGGCCAAGGCGATGGCAGACACCTACTCCG

CCCCCGAAGAGATTCATGGGCTTCTCGGCTATTGTCAGCATATGATAGACTTAATGCCCACATAATTAGGAATCGTTAAA

GAAACTTGTATGGTCTCTCAGACCTTGACTAGATATGATTTCTTTTTTTATAAAATGAGTTGGTCCCATGTTTCTACTCCAAA

AAGCTTGTGCAAATCAAATCACTCCTACATCTCATCTCTAGCATGCATTTTCTTTCTTTACCCACTCCTCACGTTTGGTTTTTT

AGGGAAAACACCATAACTAAACGCGCCGCAAGGGATCCCTATCGCACCAGATCCAAATCTAGAACGATGGGTGATCAAGA

GGAGACGCAGGAACAGATGAAAGCCGACATGTCGGCTCTGAAAGAACAAATGGCCTCCATGATGGAGGCCATGTTAGGTA

TGAAACAGCTCATGGAGAAGAACGCGGCCACTGCCGCCGCTGTCAGTTCGGCTGCCGAAGCAGACCCGACTCCCTTGGCA

ACTACGCACCATCCTCCCTCAAACATAGTAGGACGGGGAAGGGACACACTGGGACACGATGGCAGCCCTCACCTGGGATA

CAACCGAGCGGCTTACCCTTATGGATTGCCGCCCAACTATTCACCACCCGTCTTGCAAGAAGATGCGGGCCACATTGCTTC

TCCCGTCCATGAAAGAGAGCCTCCTCAGCAGCCCGACGAAGTCCACAAAGACCCTCAAGATTACGCTCGAAGGGATGTCG

AGTTCTATCCCCGATCCCCGAAGGGCGGCACCAGGCACATTGCCTCAACCCAACATCGCAGCACGCCAATAGTTTTGT

CTATGGAAGGGCCGCCCCCGGCAACTGAAGAAAGGAGGAAGCTCGATCTCCTTGAGGAAAGATTGAGGGCTGTAAGGA

TTTGGGGACTATCCGTTTGCAGACATGACGGATCTTTGCTTAGTACCCGATGTTGTTATTCCCCCGAAGTTCAAAGTGCCGG

ACTTCGACAAGTATAAAGGGACGACTTGTCCCAAAAACCACCTCAAGATGTACTGCCGTAAGATGGGCGCCCATTCTAAAG

ATGAAAAGCTGTTGATACACTTCTTTCAGGATAGCTTGGCCGGAGCTGCGGTAGTGTGGTACACTAATTTGGAAGCTTCCCG

TATCCGTACTTGGAAGGATCTGATTACCGCCTTCCTAAGGCAGTATCAGTACAATTCTGATATGGCTCCAGACCGTACTCAA

CTGCAGAATATGTTCAAGAAAGAGGGTGAAACCTTTAAAGAATATGCGCAGCGATGGAGGGATTTGGCGGCACAAGTAGC

TCCTCCCATGGTTGAGAGAGAGATGATTACCATGATGGTAGACACTCTGCCAGTGTTCTACTATGAGAAGCTAGTGGGTTAC

ATGCCGTCCAGCTTTGCGGATCTGGTGTTTGCCGGGGAAAGAATCGAGGTGGGATTGAAGAGAGGAAAGTTTGATTACGTT

TCCTCCACAAACGTGAACGCCAAAAGAATCGGGGCAACAGGGGCAAAAAGGAAGGAAGGAGATGCCCATGCCGTCTCTTC

AACGCCCGCATGGGTCAAACCCCAGCAAACACCTCATGGTACCCATCAGTACGCGCAACATCACCCAAGCTTCTCGGCTCC

TGCTGGGAACGCCTCTAGCTCAACACCCGTACAGCCTAAGGCACCCACCCAGAGGGAAGCTCCCCAAGTTCCAACTCCGA

ACGCGACTCGACCAGCCGGTAATTCCAACACGACAAGGAACGGCCCTCCGAGGCCGTTGCCGGAATTCACCCCGCTCCCA

ATGACGTACGAAGATCTTCTACCATCCCTCATCGCCAATCATTTGGCCGTGGTAACTCCCGGAAGGGTCTTCGAACCCCCTT

TCCCGAGGTGGTATGACCCTAATGCAACTTGCAAGTACCATGGGGGCGCCCCGGGGCATTCCATCGAAAAATGCTTGGCCC

TTAAATACAAGGTCCAACATCTAATGGATGCCGGATGGCTGACTTTCCAAGAGGATCGGCCCAATGTGAGGACCAACCCGC

TCGCCAATCATGGAGGGGGGCAGTTAATGCAGTTGAATCCGATAGGCCCCACAGGTCTAAACCGTTGAGAGATGTGGCAA

CCCCTAGGAGGTTTATCTTTGAGGCCCTACAGAAGGGAGGTGTAATTCCCCATAGTGGGTGTAAGGAGGATTCCTGTCTGCT

ACATCCCGGCGAGATGCATGACATGGAGACGTGTTTGGAAGTAGAGGAATTGTTACAATGGATGATAGACCAAGGTCGACT

AGAAGTCGGCATTAAAGGAAAAGAAGAGCCGCATATATGCATGCAATCTACGGAGGGGAGCGGTATTGCGAAGCCCAAAC

CCTTGGTGATATACTTTACTAAAAGTGCAGCCTCGCAAAAGCCTGGGCATCCCTTAATGGTCAAACCTGTTCCTTTCCCGTA

CCAGAATAGTCACGCGGTCCCGTGGAGATATACACCTCCGGAGAAGAAGGAAGAAGAGGTCACAGACATCAGCTCGCTGT

CGGCTAAAGTAACAAATATCACGGGACTGAGTGGTGTGACCCGTAGTGGTCGTGTGTTCGCACCTCCGGACCTACCGGTCC

AACCCGCCGACGTCAAGGGAAAAGGAAAGGTGGTGGAGGAACAAGATGGCGAAGCACCCCACGCTTCGAATAAAGATATT

CCAGCAAAGGGCCCCCAGAGAAAAGGGATGGTAGAAAGGAGGTGTCGCTAGAGGAAGCCAGCGAGTTCCTTCGGATAAT

TCAGCAGAGCGAATTCAAGGTTATCGAACAGCTCAACAAAACCCCGGCTAGGGTCTCGCTGCTAGAGTTACTTATGAGCTC

CGAGCCTCATCGGGCTCTGCTAGTAAAAGTGCTGAACGAGGCTCACGTGGCCCAAGATATTTCGGTAGAAGGTTTCGGAGG

GCTGGTCAACAATATCACTGCCAACAACTATCTTGCCTTCGCCGAAGAAGAAATCCCCGCCGAGGGGAGAGGGCATAATA

AGGCTTTACACGTATCAGTCAAGTGTATGGACCATATCGTGGCCAAGGTACTTATCGATAATGGTTCCAGTTTAAACGTGAT
```

-continued

```
GCCTAAGAGCACTTTGGACAAGTTACCATTCAATGCTTCCCATTTAAAACCAAGTTCAATGGTGGTTCGGGCCTTCGACGGC
ACTCGCCGAGAGGTTAGGGGAGAGATCGATCTCCCAGTACAAATAGGCCCTCACACCTGTCAAGTCACCTTCCAAATAATG
GACATTAACCCACCCTACAGTTGCCTGTTGGGGCGCCCGTGGATCCATTCAGTGGGTGTTGTGCCTTCTACACTCCACCAA
AGCTGAAATTCGTAGTGGAGGGGCACTTGGTCATCGTGTCAGGCGAGGAAGATATCTTGGTAAGCTGCCCATCCTCCATGC
CTTATGTGGAAGCCGCAGAAGAATCGTTAGAAACCGCTTTCCAGTCTTTTGAGGTGGTCAGCATTTCCTCCGTGGACTCCCT
CTTTGGGCAACCTTGTCTGTCCGATGCGGCGGTAATGATGGCCCGAGTTATGTTGGGGAACGGTTATGAACCCGGGATGGG
TTTAGGCAAAGACAATGGCGGCATAACTAGCCTGATAAAAACCCAAGGAAATCGTGGGAAGTATGGTTTAGGCTATAAGCC
CACTCAGGCAGACGTGAAAAGAAGCATCGCGGGAAGGAAGAACAGTGGTCAGAGCTCGCGTTGGAGACAAGAAAGTGAA
GGAAGCCCGCCCTGCCACATAAGTAGAAGTTTTATAAATGCGGGTCTGGGAGACGAAGGTCAAGTGGTCGCGATATGTGAA
GATGATGTTCCAAGAACTCTGGATTTGGTCCGACCATGCCCTCCTGATTTCCAGCTGGGAAATTGGCGGGTGGAGGAACGC
CCCGGCATTTACACAACAAGCATAATGTAAACCTTTACGTTTTTAAAAGCTCTATAGTTGGGCCTAGGCTTTAGAGTTTTCA
TTTTGTTAAGGCTTTGTGTCTTTTGTCTTTGAATTTATAATACAAAGATCTTTCTTCATCTGTTCCTGGTCTCTACCCATTCTC
ATTCATTTGCATGTTTACTTCTTTTTCTGAAACGGCAGATCCGATGACGAGTCCCCCGAAGGTACTAATACCTGGGACCCGT
CTATCAATTTCGAGCAAGAAATGAACCAAACGGAAGATGAAGGAGATGAGGGGGTGGGACTTCCTTCGGAACTAGAAAGG
ATGGTTGCCCATGAGGACCAAGAAATGGGGCCTCATCAAGAAGAAACAGAGCTAGTAGACTTGGGAATTGGCAGTGGAAA
GAGGGAAGTAAAGATAGGTGCAGGCATTACCGCACCTATCCGTGAAGAATTAATAACCCTGCTAAAAGACTACCAAGACA
TCTTTGCTTGGTCATACCAAGATATGCCCGGTTTGAGTTCTGACATTGTGCAGCACCGATTGCCTCTGAATCCCGGGTGTTC
CCCAGTAAAACAGAAATTGAGGAGGATGAAACCCAAAACGTCCTTGAAGATAAAAGAAGAAGTGAAGAAGCAGTTTGACG
CTGGATTTCTGGCCGTCGCTCGGTATCCAGAATGGGTTGCCAACATCGTACCAGTTCCTAAAAAGGGTGGGAAAGTACGAA
TGTGTGTAGATTACCGGGACCTGAATCGGCCAGTCCCAAGGACAATTTTCCGCTACCACACATCGATATCCTCGTAGATA
ACACGGCCAATTTTGCTTTATTTTCCTTCATGGATGGTTTCTCTGGTTACAATCAGATAAAGATGGCACCCGAGGATATGGA
AAAGACTACTTTCGTCACCCTGTGGGGAACGTTCTGTTACAAGGTGATGTCCTTTGGACTCAAGAATGCCGGGGCAACTTAT
CAGCGGGCCATGGTAGCTTTGTTCCATGATATGATGCATCAAGAGATCGAGGTCTACGTGGACGACATAATTGCTAAATCT
AAATCTGAGGAAGAACACCTTGTCAACCTGCGGAAGTTGTTTGAAAGGCTTAAGAAATATCAATTAAGGTTGAACCCCGCT
AAGTGCACCTTTGGGGTCAAATCAGGGAAATTGCTTGGTTTCGTTGTAAGCCAGAAAGGGATAGAGGTAGACCCCGAAAAA
GTGAAGGCTATCCTTGAGATGCCGGAACCCCGTACAGAGAGGCAAGTCCGAGGTTTCCTGGGGCGCTTGAATTATATTGCC
AGATTCATATCGCAGCTCACAGCCATTTGTGAGCCGTTGTTTAAACTCTTGCGCAAAAACCAAACTGATCGGTGGAATGAG
GATTGCCAAGAGGCTTTTGGAAAGATCAAAAAGTGCCTAATGAATCCTCCTGTGCTTATGCCACCAGTACCTGGAAGGCCT
CTCATTTTGTACATGACAATCTTGGACGAGTCAATGGGGTGTATGCTGGGGCAGCATGACGAATCCGGGAAGAAAGAGCGC
GCTGTTTACTACCTAAGTAAGAAGTTCACGACCTGTGAGATGAATTACTCCTTGCTCGAAAGAACGTGTTGTGCTTTAGTAT
GGGCGTCCCATCGCCTAAGGCAGTACATGCTGAGCCATACTACCTGGTTGATATCCAAAATGGACCCGGTTAAGTACATCT
TTGAAAAGCCAGCTCTCACAGGACGAATCGCCCAGTGGCAAGTCCTGCTATCTGAGTTTGATATAGTCTACGTCACCCAAA
AGGCGATAAAAGGAAGCGCTTTGGCAGATTATTTGGCTCAACAGCCTCTTAACGACTACCAGCCATGCATCCGGAATTCC
CGGATGAGGACATCATGGCCTTGTTCGAGGAAAAGTTGGACGAAGATCGGGACAAATGGACTGTATGTTTGACGGAGCGT
CAAACATTCTAGGTCATGGCGTTGGGGCAGTGTTGATCTCTCCGGACAATCAATGTGTACCTTTCACAGCCAGGCTAGGATT
CGACTGCACCAACAACATGGCCGAATATGAAGCATGTGCCCTAGCCGTCCAGGCAGCAATTGACTCCAATGCCAAACTACT
CAAGGTGTACGGCGACTCAGCGTTGGTAATCCATCAGCTGAGAGGGAATGGGAAACTAGAGATCCCAAGCTGATACCCT
ACAAAGCCTACATCAAGGAATTGGCTAAGACTTTCGATGAGATCTCCTTCCATCATGTTCCCCGAGGAAAATCAAATGG
CGGATGCACTTGCTACATTGGCATCTATGTTCCAGCTAACACCGCACGGGGACCTACCCTACATTGAATTTCAGTGTCGTGG
CAAACCCGCACATTGTTGCCAAGTGGAAGAGGAACGGGACGGAAAGCCCTGGTATTACGACATCAAGCGATATGTCGAAA
```

-continued

```
GCAAAGAATACCCGCCGGAGATTGCCGACAACGATAAAAGGACATTGAGGAGGTTGGCAGTCAGTTTCTTCATGAGCGGA
GGCACACTGTATAAGAGAAATCACGACATGACACTCCTGCGATGTGTGGATGCCAAGGAGGCAAATCACATGATCGAGGA
AGTCCATGAGGGCTCGTTTGGAACACACGCCAACGGGCATGCTATGGCCAGGAAGATCTTAAGAGCAGGTTATTACTGGCT
TACCATGGAAAGTGATTGTTGTGTCCATGTGAGGAAGTGCCACAAATGTCAAGCGTTCGCAGATAATGTCAATGCCCCACC
ACATCCTCTGAATGTCATGTCCGCCCCTTGGCCTTTCTCCATGTGGGGAATAGATGTCATCGGGGCCATTGAGCCCAAGGCC
TCGAATGGTCATCGCTTCATCCTCGTAGCGATAGATTATTTCACCAAGTGGGTCGAGGCGGCTTCATATACCAATGTCACGA
GGAATGTGGTGGTCAGGTTCATTAAGAAAGAGATCATCTGCCGATATGGTTTGCCAAGGAAGATTATCACGGACAATGGCA
CCAACCTGAATAATAAGATGATGGCAGAAATGTGCGAGGAGTTTAAAATCCAGCATCACAATTCCACGCCTACCGGCCAA
AGATGAATGGAGCCGTGGAAGCAGCCAATAAGAATATCAAAAAGATTATCCAAAAGATGACCGTGTCATACAAGGATTGG
CACGAGATGCTCCCATTCGCGTTACACGGTTACCGGACTTCAGTGCGAACGTCAACTGGGGCAACGCCATTCTCATTGGTA
TATGGGATGGAGGCGGTGTTACCGTTTGAGGTAGAAGTCCCGTCATTAAGGATTTTGGCAGAATCCGGGTTAAAGGAATCA
GAGTGGGCTCAAACACGCTACGATCAGCTCAACCTCATTGAGGGTAAGCGCTTAACGGCCATGAGTCATGGGCGCTTATAC
CAGCAAAGAATGAAGAGTGCATTCGACAAGAAAGTACGCTTACGCAAGTTCCATGAGGGAGACCTTGTGCTAAAGAAAAT
GTCCCATGCTGTCAAGGACCATCGAGGGAAATGGGCCCCGAACTACGAAGGGCCTTTTGTCGTGAAGAGGGCTTTTTCCGG
AGGAGCTCTGGTGCTTACCAACATGGATGGCGAAGAGCTACCTTCACCCGTGAACTCTGATGTCGTCAAACAATATTATGC
TTAGAAGCTGGGGCAATTAAGGATGTCGCTGCATGTTCTGTATCTTTATGCGTTTTCTGGATTTCCCCCAGGGATTTCCTGTC
TGTTGTATCTCTCGTTACAATCTTTCAAAGAAATGAACGTGGATTCGAGGCTTTTAGTCCTCACGTTAGTTTCACATCTTGCG
TTAATTTGTGATCACCTGAGCCCTTCCGCTCAGTTCATGGGATCCCCCAAGCGCTTAATTAGAATTGAACCTGAACCAACTT
TCCCTAAATTTTCTGCGTTTGAAAACATTCATGCATACGCATACGCATACGCATGTATATTGTTGTGGTAAAACAGGGGCAG
GATCACCTTGGGCTACTTTCTGGAGTGAGGACAAAACAGGAATGGCAGAAACCAGTCAAGGTAGGGTAATGATGCGGCCA
AAATTGGCCATACCTGGTTGTTTATTACTTGCAGGTACTTAAGGATGAACGCAAGCGGGGATGGGGTCACGACCGACCGAT
CGTTGCCCTTCTCTGTGCGAAACAAGCAGGGAATGTCGCTGCAAGGCAGCCCCGTATCCTTTCTATTTTGTAGCTTTCTTTTA
CTATTTGTTTGTTTTAAAAAAAGGAAAAGAGTAATAATAAGATAAGTAATCAACGCCTGATTCTAACCTAAGTAAGTTCAAG
TTAGGCAAAAGGCTAATCCATGAGAAGGGAGGGGACATGGTCAATGTTCCCCTCAAAAAAAAAAAAAAAAAAAAAAAAAAG
TGCAGGTTAGCTCGCCTGGGCGAGCTGGGCTCGCCTGGGCGAGCCACCTCTGCACCAAAATATAAAAATGACGAAGGGGG
GGATGTTTTTTTTCATTCAAAAACTTCCCCCCCTCATTCAAAAAAAGAAAGCTCACGGGACTCACGGATTTTGCAGCCCTTA
GGTCACCATTTTTTGCGTTTTTGATTCCGTTTTGCTCTATTATTCGTCTCCAACAAGTAAGTACCTCATTCTTGGGCTTTCTAG
CTTTCCATTGATGTATTTTGGTGCTCTAAATTGCATGTGTTTGCTAAGAAACGTGAGGGATTTATCCTCAAATTGTTGCTTGT
TTTTGTTGAATTGAGGGGTTGTAAGGGATGGCCTTGGCCTAGGGTGTATTCTGAAGTAATGGCGCATGCCACATTGTCCCCA
TTCTCTTGATATTCGTGCCTAAACATGCGCCCACCAAGTGCTCGGTGAAATGCCTCAACGACATATGAGCATGGTTTTGTGA
GCTTTGGGTTGTGGACTGTTTTATATGTATAGGGACAGCATGAAGGATTTAAAATGAATGCCCGAATGCAATTCTAGGCCT
AGGAACCCAAGCTTTTAATTTCAATACAAGGAAGCATGACTTACGCCTAGGAATCTAAGTTTTGGTTTTGAATGTAAAAGG
CATGAATATTAGGACATGTTTGAGAGGTTGTTATTAGAATTTAAATTTGGCTGCCCCATGAGGAATACCTTGCACCTAGGTA
GCATGGAAAATACCTTTCAACGGTATGTATATATGTGAATATATATAGCATGGAAATGCCTTGCAAAATATGAATATATATA
GTATGAAAATGCCTTGCATAATATGAATATATATAGTATGAAAATGCCTTGCATAATATGAATATATATAGCATGAAGTGCC
TTGCAAAGTGTTGGATGGGTAGCGTAAAAGTGTTTTTCAAAATATATGTATTTGTGAGTAGGTAATAAAAGAAAACCTTCCAA
AAAATGTATATATATAGGATGTAGCATGAAAAGGTTTGTCAAAAAATATGTACATGGATAGGTGTCGAAAATGCTTCA
CACAAAATTTTTTATGTGTGCAAATACGTATGTGTCATAAAATAGCACGACCCCAATATGATTATTTTATAAAGTGCATGTT
GACACTCGGGCCATGAGAAGTGTTGTTTGGCCCTTGTTTGTAATGATTGTTATATTTCTTGTAAACTAACTTTCCAAATGTTT
GCCTTCGCAGGAATGGCCCCGAGGAAGCTTGCCTCAAAGAGGTCCAGGAAGGACAAGGCGGCCGAAGGAACTAGTTCCGC
```

-continued

```
CCCGGAGTACGACAGTCACCGCTTTAGGAGCGTTGTACACCAGCAGCGCTTTGAAGCCATCAAGGGATGGTCGTTTCTCCG
GGAGCGACGCGTCCAGCTCAGGGACGACGAGTATACTGATTTTCAGGAGGAAATAGGGCGCCGGCGGTGGGCACCACTGG
TTACTCCTATGGCCAAGTTTGATCCAGAAATAGTCCTTGAATTTTATGCCAATGCTTGGCCAACAGAGGAGGGCGTGCGTGA
CATGAGGTCCTGGGTTAGGGGTCAATGGATCCCGTTCGATGCCGACGCTATCAGCCAGCTCCTGGGATATCCGATGGTGTT
GGAAGAGGGCCAGGAATGCGAGTATGGCCAGAGGAGGAACCGGTCTGATGGGTTCGATGAGGAGGCCATCGCCCAGCTGC
TATGTATACCGGGGCAGGATTTTGCCCGGACCGCTGCAGGGAGGCGAGTGCGAGTCATGCGCACCAACATGACCACCCTG
ACCCAGATATGGATGACGTTGCTCCTCAGCAACATCCTGCCCACCGATCATAATTCCGACCTCCCCATGCCTAAGTGCCAG
CTGGTGTACGCCATCCTGACACGGATGAGCATCCATGTGGCTCAGTTGATCGCTGATGCCATCTATATTTTTGCAGGTATGG
CGCCCACTAGGCACCCTTTGGACCCAGATAAGTCCAACAGGGCTCTGGGATTCCCCGCACTGATCACAGGACTCTGCCAGT
CGTTCGGAGTCCCCGTTGCACCTACCAAGGTGATTCGGCCGCCCATCACCCGGGCTTTTATTGAGAAGTACTGTACCCAGA
GACAGGCTCAGGGTGATGCTCCACAGGCCGCAGGCGTGCCACCACCACCTCATCAGGCTGGCCAGGCTGGGGCATTTGAC
ATAGAGCAGTATTTACGGCATTTGGTTCGCCAGCAGGCGGCCAACCACCGAGCACATGTACGGACCCATGATTGTCTGTAC
CAGATGAGCCTTAGCATGCAGAGCCAGGGCTTCGCTCCTTTTTCATGCCCTACTCCAGACCAGTTCAGGGCAGAAGTTGCA
TGGCCCGGAGATTGGCCCGAGGCCCAAGCAGGAGAGGCACCCCCAGAAGCTCCCGGCGATGGAGAAGAAGCCCACGAGG
ATGAGGAAATGGCTGATTTGCTTGACTTCTTGGGAGGGAGTGGAGACACGTGACTGGGAGATCCCCAGATTCATGTTTTCTT
TCATATTTCTTTTGTCATTTTTTTGTTCTATGTTATTGTTTTGACTTGAGAGACTAACGTTTGTTTTTGTTGTTTCGATTGTCAT
TTTGTACAGTGCATACATTTTTGTTTAGATTGGTGCGTTAGTATTTATATATCATTACTATCGATGATGTTTGAAATTCTGGA
ACCGTGTAGAGTTCTTCGTTTAGGAACATCGTCCAAAGTATATATGTAAAATAAACAAAAAAATCATGATAAAAGTAAAAA
ATAGAGAAGGAAAGAAAATGAAATAGAAAAGGAAAGAAAATGAAATAGAAAAGAAAAGAAAGTGATAAGGAAAAAGAG
AAGGCAAGAGAAATAAGTTGTCTAGCTAAAAAACCAACATGCTTTTGAAAAGAGACGATTTCCAACTTTTCTTTGAAAAA
AGTTCATTGATCATAACCAATTCTTGGAAAATGTGTCTACACCTGAAGGGTGAATGCTGTGAAATTTCCCCGGATGCCCGAA
ATGGACTCGGATGAATGCACAAATTGATAAAAGAACATATTTTGGAAACATTGGGTCGATTAAAATAGAGGGAATGAATCC
TGAGCCCTAGCATCACATGACCATAAAAGTTTGACACTTGAGTGTCCGCGTAGATGCATGCATGACCAGTTTTGCATAAAG
TTTCCAAATCATCATTTTCGCATTTGTGTCATGGAAATAATGTGGGCATCCCTTTTATCCTTGAACCAAACCAAACCCTGA
CATGTATCATGTCTAGCCATTCTACAAACCTTGATTCAAAATCATGACTCACTATAATCCTTACCCTCGGAAAGCAAAAAAG
GAAAGAAGGAAATTTTCCAATCAAAGAGAAAGCAAAAGAAAAGAAAGGAAATTCCCAATCAAAGAGCGGGAGAAAGCA
AAAAGAAAAGAAAGGAAATTCCCAATCAAAGAGTGGGGAAAGCAAAAAGAAAAGAAAGAAAATTCCCAACCAAAGAAT
GGGAGAAAGTAAAAAGGAAGGAAAGAAAGTTCTTGATCAAAGAAACTAGAAGAAATGTGCAGAAAGGTCTTTTGACCAGA
CAATATCTGAACAATACAGAATTGTCACCAAATGAACAAAAAAGAAGGAAAGGAAACCACGACCTAAAATGGTCTTCTCC
CTTTGTTTACCAACCAAAATCCCGTGCGCTAGCGACCTTTTTTCTCGCCCCGCACTAAACAAAAAAAAACAGACAGAAAA
GGAAAAGCTAGAAAAATCAAAAGCCAAAAACACACAAAAGCCGAAAGAAGAAACCACCAAAAGAACCCATTCCCAAGGG
AAGCCCTATTGATCCATGATCACGCGTGTAATTTTTGATTTGATAGGAAATAATTTGTAAAGTCAAGTCATGACATATCTAT
GGTTCGGAATTAGGATGAAACACTTACCTGTGCGAGATTGATACACTTTGAGTAGATTTCTTCTATTTTTGTCGAACCCAGT
GTTTCCTCTAAATGGTCATTTAGAAACGAAATGCTAACATCCAAGATCTCATTTATGGTTATGGGGGATCCCATCAGCAGA
CTCTCCTTCCCTGGTAGGCGCATTGTTTGTCACTCAAAAAAAAAGCATATGCTGCTCTAAATCAGTTGGAATATTTGTCTCTT
TGCTAAAGCATGTTTGCATTTTAGTGGAGAAAACAACGAAACTTTTTCAAGCCTCACAAGTTATCCAGAACTACGTAGGTCT
GAGTTCCTCATTGGAGGATACGTAGGAGCAAGAGCCTCGCTTTTGTCGACCACACCGCCTTTTGTTGCCATAACTCAAGAG
CTGGTAGTACGCGGAGATACCTTACGCTTATCCGCACCCCTTTTGCCATTCAGACACAGTCGTGTCCGTTGGCAAGCAGAG
ACCAAGTTTGGTCATTCTGCACACATGATACGCGGAGATACCTTACGGTTATCCGCCCCCTTTGCCATTCAGACACAGTCG
TGTCCGTTGGCAAGCAGAGACCAAGTTTGGTCATTCTGCACACATGATACGCGGAGATACCTTACGGTTATCCGCACCCCTT
```

-continued

```
TTGCCATTCAGACACAGTCGTGTCCGTTGGCAAGCAGAGACCAAGTTTGGTCATTCTGCACACATGATACGCGGAGATACC
TTACGGTTATCCGCCCCCCTTTGCCATTCAGACACAGTCGTGTCCGTTGGCAAGCAGAGACCAAGTTTGGTCATTCTGCACA
CATGATACGCGGAGATACCTTACGGTTATCCGCCCCCCTTTGCCATTCAGACACAGTCGTGTCCGTTGGCAAGCAGAGAC
CAAGTTTGGTCATTCTGCACACATGATACGCGGAGATACCTTACGGTTATCCGCCCCCCTTTTGCCATTCAGACACAGTCGT
GTCCGTTGGCGAGCAGAGACCAAGTTTGTTCATTCTGCACACATGATACGCGGAGATACCTTACGGTTATCCGCCCCCTTT
GCCATTCAGACACAGTCGTGTCCGTTGGCAAGCAGAGACCAAGTTTGGTCATTCTGCACACATGATACGCGGAGATACCTT
ACGGTTATCCGCCCCCTTTGCCATTCAGACACAGTCGTGTCCGTTGGCAAGCAGAGACCAAGTTTGGTCATTCTGCACACA
TGATACGCGGAGATACCTTACGGTTATCCGCCCCCCTTTGCCATTCAGACACAGTCGTGTCCATTGGCAAGCAGAGACCA
AGTTTGGTCATTCTGCACACATGATACGCGGAGATACCTTACGGTTATCCGCCCCCTTTTGCCATTCAGACACAGTCGTGT
CCGTTGGCGAGCAGAGACCAAGTTTGGTCATTCTGCACACATGATACGCGGAGATACCTTACGGTTATCCGCCCCCTTTG
CCATTCAGACACAGTCGTGTCCGTTGGCAAGCAGAGACCAAGTTTGGTCATTCTGCACACATGATACGCGGAGATACCTTA
CGGTTATCCGCCCCCTTTGCCATTCAGACACAGTCGTGTCCGTTGGCAAGCAGAGACCAAGTTTGGTCATTCTGCACACAT
GATACGCGGAGATACCTTACGGTTATCCGCCCCCTTTGCCATTCAGACACAGTCGTGTCCGTTGGCAAGCAGAGACCAAG
TTTGGTCATTCTGCACACATGATACGCGGAGATACCTTACGGTTATCCGCCCCCTTTGCCATTCAGACACAGTCGTGTCCG
TTGGCAAGCAGAGACCAAGTTTGGTCATTCTGCACACATGATACGCGGAGATACCTTACGGTTATCCGCCCCCTTTGCC
ATTCAGACACAGTCGTGTTCGATGGCAAGCAGAGACCAAGTTTGGTCATTCTGCACACATGATACGCGGAGATACCTTACG
GTTATCCGCCCCCTTTGCCATTCAGACACAGTCGTGTCCGTTGGCAAGCAGAGACCAAGTTTGGTCATTCTGCACACATGA
TACGCGGAGATACCTTACGGTTATCCGCCCCCTTTGCCATTCAGACACAGTCGTGTCCGTTGGCAAGCAGAGACCAAGTT
TGGTCATTCTGCACACATGATACGCGGAGATACCTTACGGTTATCCGCCCCCTTTGCCATTCAGACACAGTCGTGTTCGA
TGGCAAGCAGAGACCAAGTTTGGTCATTCTGCACACATGATACGCGGAGATACCTTACGGTTATCCCCCCCCCTTTGCCAT
TCAGACACAGTCGTGTTCGATGGCAAGCAGAGACCAAGTTTGGTCATTCTGCACCCATGATACGCGGAGATACCTTATGGT
TATTCGCACCCATTCTTTTGCTATCTGTAAGACAGAACGCTTGATAGCATGCAGGGGCTGACACAGTCTTCTGCACCTTTTG
TTCCTCTGGGAACAACAAGTCATTTGCATGTGGAGATTTTATGGTCACCCGCGACTCTCGTCGAAACGAGAAGGACGAAAT
TAGTGTCTTATCTTTACTTTTCTTTTATCTCCAATAAAAGACAAGTAAAGAGGGGCAACTGTCATACCCTAATTTCGTCCGG
GAACCTTTGCTCGATGACATGCGACCATTCTTTGGTCCTTGTGAGGTGCTTGGCACCCATCATTAGGAATTTATGAAATTC
CAGGACATGCCGAAAAACCAAAAAAAAATATTGATGCACAATCCGTAAGTTTCCGTGACACACCGGAAATCAAAAGGAAGC
ATCGTTGCATAATTAAGTGAGGTTCCGTAACATTCCGTAAGTCAAAAAGGGGATGATTATGTAATTCGCAAGGTTCCGTAAC
ATTACGGAAAGAAAATAAGTATCGTTACGAAATTCGTAAGTTTCCGTAACTTTACGAAAAAAGAATCACCAAAAAAACAGC
AGAGGGGTGTATTTAGTAAAAATGGGGGTGCAAATAGCACCCAGGCCCACTTGGGCCCTCCAGAAGATTCCTCCAGAAG
GCGGTTGCTTCTGGAGGAAGCAACCCTGCTCGCCTGGGCGAGCTGAGCTCGCCTGGGCGAGCTGGGCGGCAAGCATCTCCC
CTATTTTGCTATAAATAGGGGAGAAAATGAAGAAGAAAAGGATCCCAGCCCTTTAGGCACTTCTCTCTCTTTGGAATTTGCT
TGGAAAAATTGTTTCCGTGAAGAAAATCTAAGCCGAGGCGCTTCCGAAACGTTTCCGTAACGTTTTCCGTGAGGAATCTCG
CAAAGGTTTGAACCGTTCTTCGACGTTCTTCATTCGTTCTTCATCGTTCTTTGATCTTCAACGGGTAAGTACCTCGAACCAAG
CTTTTCGATTCATTCTATGCACCCGTAGTGGTCCACATTGTGTTTCGTGCATTTTGATTCTCATTTTGTTTACTCTTTATACCC
CCTGTTGACGTGCTTAAGCCATTTTACTTAAGTCGTTTCTCGCTTAACTTAAAAATAAAATAAATTTCCACCGAACGTTTGA
ATTGTATTATCCATTAGCTTCGGTTAAAATAAATTCCGACCGTTCGGTCATGCCGTAACCACGTTGGAAATCAAAAAGAGGT
AAAAAATAATATAATAATCAAAAAGACATCTTTTTAGTAAAATAAAGCGGAAAATCAATCGGACGTTTTCTCTTTGGGATTTC
TCATTCTTAACCGAATTGATTAATAACTAAAGTGAAACTAAGGCTAACATCAACTCGCCTAGTCAAGCTCGTCCACAAAAA
TAAGCTTTTGAAGTTTGTCATTTCAATTTCTCACTAAGTAAAAT
```

-continued

>BAC99.FASTA.SCREEN.CONTIG4 (SEQ ID NO:180)
TCACTGAATATATTAATAATAAAATTTTTATATAAATAAGATTCAAAGGATAATCACCAACCAAGAAATTTTATGGAAGTAT

TTATCAAATAATTACAATAGATATATAACATAAAAAAAAGAGTTGAATTGAATAATAATTTTTCATGCCATCATTTCAAAAG

AATTACTTTAATCACTCTCTTTATATTATTATTATTATTATTATAACATCTTCACAATATTTTTTATTTTATTAGTATTTATTGA

TTTTATTTAATAAAAAATCACACACTTTTCTTTTTGCACACATCTTTAATCTACATATAAGGATATTCAAATCTTGACTTCAT

TAATATATATTATTGTTTTAGGGATCAATTAGCATGTGTCTTTTCTTTAATTCTTTCTCTTTTAATTTGTTCAACATTTTTATT

GTGTTAATAATTTTTTAATCTCATTTTTTATTTTCCTCCTAACAAAATTTATTCTATATATAAGAATTAATAAAGATTTAAAT

CTTTTACCACTTGATTAAAAAACATAAATTACTATCAATTATTTTAACTTTTTATAAAATCATGATTCAGATCTTTATACAAT

AACATATCTCATCATGTGTTAGTTGTTTATATCATCACTCTTTAAATCTCTTGAGTCTTTAGTTTAGAGGAGCTAAATTCAAA

ATAGAAATATCAAGAAAGTAACATATGTGAGGATCAAAAGTAAAGAGACTCCCAACGTGATAAGTCACCCACCACCATAA

TAATACAAATAATAAAAATAAAAAAGACCATACTTTTGTCTTGCACAGCAGAACGAGTGAATGAAGAGAGTTGACTTAA

GCCAAATCTCATCACATCAGTTCATAGCAACCAATTCCCTTGCCTTTGTCTTTCTACTCTGATCATCTTTTGTTCTTGAGATA

ATGGCTGCAGCACTGGTCGGTGGTGCCTTTCTCTCTGCTTTCCTTGATGTGCTTTTCGACAGGCTGGCTTCACCTGACTTTGT

TGACTTGATCCTTGGAAAGAAGCTTAGCAAGAAGTTGCTTCGAAAGTTGGAGACCACTCTCAGAGTGGTTGGAGCTGTGCT

TGATGATGCCGAGAAGAAACAGATCACAAACACCAATGTCAAACACTGGCTCAATGCTCTCAAAGATGCTGTCTATGAAGC

CGATGACTTACTCGACCATGTTTTCACCAAAGCTGCCACCCAAAACAAGGTAAGAAACTTGTTTTCTCGCTTTTCCGATCGG

AAGATCGTTAGTAAGTTGGAGGACATAGTTGTCACCCTAGAGTCTCATTTAAAACTCAAGGAGAGTCTTGATTTGAAAGAG

AGTGCAGTGGAGAACTTGTCATGGAAAGCTCCATCAACATCTCTGGAAGATGGATCTCATATATATGGTAGGGAGAAAGAT

AGGGAGGCCATAATCAAGTTGTTGTCGGAGGATAACAGTGACGGTAGTGAAGTGTCTGTGGTTCCTATTGTGGGCATGGGT

GGGGTTGGAAAAACTACTTTGGCCCAATTGGTGTACAATGATGAGAATTTGAAAGAGAAATTTGATTTTGATTTTAAGGCAT

GGGTTTGTGTTTCTCAAGAATTTGATGTTCTGAAGGTCACAAAAACTATAATACAGGCGGTTACTGGAAATCCTTGTAAATT

GAATGATCTGAATCTACTTCATCTTGAATTGATGGACAAGCTGAAAGATAAAAAATTCCTAATTGTTTTATGATGTTTGG

ACAGAGGATTATGTTGATTGGAGTCTTCTTAAGAAACCATTTCAATGTGGGATTATTAGGAGAAGTAAAACTTCTAACAA

CCCGCAGTGAAAAGACAGCCTCCGTAGTCCAAACGGTTCAAACCTATCATCTAAACCAATTGTCGAATGAAGATTGTTGGT

CAGTGTTTGCGAACCATGCGTGTCTTTCCTTGGAATCGAACGAGAACACAACACTAGAAAAAATTGGAAAGGAGATTGTTA

AAAAGTGCGATGGACTGCCTTTAGCAGCACAGTCCCTTGGAGGCATGTTGAGAAGAAAGCATGACATTGGGGATTGGTATA

ATATTCTGAATAGTGACATTTGGGAACTTTCTGAAAGTGAGTGTAAAGTTATTCCAGCACTGAGACTTAGTTATCATTATCT

CCCTCCACATTTAAAACGGTGCTTTGTTTATTGTTCGTTGTATCCCCAAGATTACGAATTTGATAAAAATGAATTAATCTTGT

TGTGGATGGCTGAAGATCTTTTGAAGAAACCAAGGAAAGGTAGGACTTTAGAAGAGGTTGGTCATGAGTATTTTGATGATTT

GGTTTCGAGATCATTTTTCCAACGTTCAAGTACAAATAGAAGTAGTTGGCCTTATGGTGAATGTTTTGTGATGCATGACCTC

ATGCATGATCTAGCCAAATCACTCGGTGGAGATTTTTATTTTAGATCAGAAGAACTTGGGAAAGAAACAAAGATCAATACT

AAGACTCGTCATTTGTCATTTACCAAATTCAATTCTTCAGTCTTGGACAACTTTGATGTTGTTGGTAGAGCAAAATTTCTGAG

AACTTTCTTGTCCATTATCAATTTTGAAGCTGCTCCATTCAACAACGAGGAGGCACAATGTATCATTGTGTCGAAGCTTATG

TACTTGAGAGTTTTATCATTTTGTGACTTCCAAAGTTTGGATTCTTTGCCTGATTCAATAGGTAAATTGATCCATCTGCGCTA

TTTAGATCTTTCTCATTCAAGTGTAGAAACACTGCCAAAGTCATTGTGTAATTTATACAATCTGCAAACTTTGAAGTTGTGTA

GTTGCAGAAAGCTGACTAAGTTGCCTAGTGACATGTGCAATCTTGTTAACTTGCGTCATCTTGAGATACGTGAAACTCCTAT

AGAAGAGATGCCGAGAGGAATGAGTAAATTAAATCATCTACAACATCTGGATTTCTTTGTTGTGGGCAAGCACAAAGAGAA

TGGGATCAAAGAATTGGGAGGACTTTCAAATCTTCGTGGTCGACTTAAAATTAGGAACTTGGAGAATGTTTCCCAAAGTGA

TGAAGCGTCGGAGGCAAGGATGATGGATAAAAAACACATTAATAGTTTATGGTTGGAATGGTCTAGATGTAATAACAACAG

TACCAACTTCCAACTAGAAATAGATGTGCTTTGCAAGTTACAGCCTCACTTTAACATTGAATCGTTGAGAATAAAAGGCTAT

-continued

```
AAAGGAACCAGATTTCCAGATTGGATGGGAAATTCTTCCTACTGCAATATGATGAGTCTAAAATTGCGTGATTGTGACAACT
GTAGTATGCTTCCTTCACTTGGACAACTACCTTCTCTCAAGGTCCTTAAGATTGCACGATTGAATAGGCTGAAGACTATTGA
TGCAGGTTTTTACAAGAACGAAGATTGTCGTTCTGGGACGCCCTTTCCCTCCCTTGAATCTCTGGCCATTCATCAAATGCCT
TGTTGGGAGGTGTGGAGTTCCTTCGATTCAGAAGCTTTTCCTGTGCTTGAAATTCTTGAAATACGTGACTGCCCCAAACTAG
AGGGAAGTTTGCCGAATCACCTTCCTGCTCTGAAAACACTTACAATTAGAAATTGTGAGCTGCTTGGCTCTTCTCTCCCAAC
GGCTCCCGCCATTCAAAGTTTGGAGATACGTAAAAGCAATAAAGTAGCACTGCATGCGTTTCCTCTCTTGGTAGAAACTAT
AAAAGTAGAAGGAAGCCCAATGGTGGAGTCCATGATGGAGGCCATCACAAACATCCAACCAACTTGTCTCCGGTCTTTAAC
ATTAAGGGATTGCTCGTCAGCCGTGTCATTTCCGGGTGGTCGTTTACCTGAATCACTGAAGAGTCTGTATATCTCGGATCTT
AAAAAACTGGAATTCCCGACGCAACACAAACATGAGTTACTGGAAACACTGTCAATAGAAAGCAGTTGTGATTCACTCACA
TCTCTTCCATTGGTTACCTTTCCAAATCTCAGAGATCTTGAAATCAGAAACTGTGAAAATATGGAATCTCTTTTGGTATCATT
CTGGAGAGAAGGATTGCCTGCGCCCAACTTGATTACTTTCCAAGTGTGGGGCTCTGACAAGTTGAAGTCGTTGCCTGATGA
GATGAGTACTCTTCTCCCAAAGTTAGAACGTCTCCTCATATCCAACTGCCCAGAAATTGAGTCGTTTCCAAAACGGGGTATG
CCACCTAACCTGAGAATAGTTTGGATTTTCAATTGTGAGAAACTACTGAGCAGCCTAGCATGGCCATCCATGGGCATGCTTA
CTCATCTCTATGTTGGGGGTCGATGTGATGGCATCAAGTCCTTCCCTAAGGAGGGTTTGCTGCCTCCCTCCCTTACGTATCT
GTATCTAAGTGGATTCTCAAATCTGGAGATGTTGGACTGCACGGGCTTCTCCATCTCACATCCCTGCAACAATTAACCATA
GACGGATGTCCTTTGCTGGAAAATATGGTGGGAGAAAGGCTTCCTGACTCTCTAATAAAATTAACCATAAAGAGTTGTCCTT
TGCTGAAAAAACGATGCCGGAAGAAGCACCCTCAAATTTGGCCTAAAATTTCCCACATCCCTGGCATTAAGGTTGACAATA
GATGGATTTAGCCACCAAGGAGGACCAACAGGTATCTTCTAAGTCTAACCAACTAGAAAACTAGTTCTGTCAAGGATATGT
TTCATTTCATGTCTTTCTCCTTTTACGTTTTACTAAATCCAATTCATTCTGAAATGGAAATTGACCTTGTATATATGTTACTGA
ATCTACAGAGAATCAACAAATCATCAAAGGCAACGTGGAAATTGACCTTGTATATATGTTTCGAAGAAGTAACGATACAGG
TACTAAGTAACAACATTGATAAATACTTAAATATAATGATTCTCCGGAAAAATGTTACACATCAGTATTGTTATATTCTAAC
TTAATTTCTCCTTAAGATTATTGAGGCCAGAGTGAAAATGACCGTGGGAAACTTATTTTTGTTTTTCAGATATGGTTGATTGG
CCCGGAGAAACTGTACCTACCCATGAATCTAAGTTCAAATTTGAACTAGTGCTAAATGTAACTTTTAATTTAATTGACGTCA
AATTGACACTTTCTCAATAGCTAAATTTTTATTTGTGAGGTTTTTTGTTAGGTACAATGTGAAGGATGAAAAGGTGTACCAA
GTGAACTTTAGAAGGATTGGATGATTTCAGCTTATCTCTTATCTCCTGTCCTATAAATTAATAGTGGTATGATTATTCTAAAA
ATATGATAGATATGTAGATACGTAAGAATTGATAAAAGCATAATAAATATACAATTGCAATTCGGTAAATTGAAGAACATA
CATACTTCTTAGACATTGCTAAAAACAAAATCAAAAAATTGTAGATCATTTTTTCCTATTGTTCACAAATAAGAATGGTACT
ATCAATGATCAATCTCATTTCTTTCTTGAAATTATCTATAAACAAAACAATTTTCATATTTGGTTCATCAAGAAACAATACTT
TTTATATTTCTATATTATATTTACTTCTATGTTACATGTCACTATATTTGATTATCATAATTTTTTTTAAAAGAATTGGTCACT
TTACATATATGTACCAGTGAAATATATCAATATATTGGTATCGGATATAGATGCATGAAGCAAATTAAAGTATCAGTACTTT
GTAGCAAAACACATTCTTCAAATCATGACATGAGGTAAAAAAATATGATGATATTTTTGTAAGTATTGGAAAAAAAAAAAA
AAGTAAAGCTTCTGAAATCAAAGAGACACTAATTTTCCACAACATCCTTCAATTGGGCCCAAGCTTCCTTTCCTATTGACAA
ATAACTGGTTGTTAGTGCCAGCTTTTTCTTTTTTCTAGTTTTCCATTGATGGTTAAAAGCTAATATGAACCTGTCACTCCTTA
AAATTTCCACCAAAGTTTGGTAAATAAATATATAGGAGAGTGAATAATGCAAGCCTTGCATTCTATCTCTAAGTTACTAGGT
ATATGAAACAGGTATGGGTATGGTTTTAGAAGGTATGTGGTTCATCACTATTTATATTTTTACTACAAGAACCAGGTAAACT
TTATTATGGTACAGTAAATTTAGTGTGAGGTTGTAACTACGTTATATCCATCTAACTTAGCACGATAATTAAATTTAAAAGC
AAAAAGATAAGAAAAAGGCCAATCTAACAATTGTTACCTCTCTTGCATGAAAAAATCAGAAACAAAAGCCCCACTCTTTCC
TCCATGGTGCCTGTAATTAACAAGCACTTCAAAAATCAATGTTAATTAATTAATTTCCATAAGAAAAAAAAGACAGAAGCT
AATGAAATTTAAGGGGTACAACAAAGATTTGTAGAACGATCATTAATATTAGTGCAACACATCATGATGAAGTGCATGACA
TAATAATAATGTGAAACCAATCATGATAAGAACAGAAAATAAATCAGTGCAATTACATGATTAGAAAATAAAGAGGCGAT
```

-continued

```
ATATCATATTCCTATTGATCAGACAATATGACAACGTGTTAAACAAATGTGTCAGGTGCAATAATGAGGGGATAGAGAAGA
GAAGGATGATAAAGAATGTGGTTATGACTTCTACAAAGTCGAATTATTTACTTTTTTAATTTTTATATTTTCCTTTTCACTTT
TCTAATAGTTGTCCGATTAAGAGGAGTTTATAGAGTAGATTAAATTGGTTTTGAAAAAGAGAAATATCATCTTATACAATTT
TTGGTTTTCTTAATTCATTGTTCAATTGATGTAGTTTAAAATTTAAATATGATTTAATAAGTTTGGATTGATCTCGATCTTAAG
TTTTAATTTTAATTCTATTTTTTCAAAAAAAAAATATTAAAGATATATAATAACTGTGATACAAAGTAATTTAAAATATTTTA
CCAAAAAATGTAATTTAAAATATCACATATATATAAATCATTTTAAAGCTAATAGTAATATTTTCTAAAAAGAAGCTAAAAG
TATATCTCTGTTATACAAGTTGATAATTATATTTATATATACTTGAATAGTTACTGAATATTATATTTAATTAAATTTACTTTT
CATAAATAATTTTTAAGTAATGTAATAATTTTTATATATATATATATATATATATATATATATATAATAAATAAAAATATA
AACATCAATGATATCATAAAATTTTGGTAATAATAATTTTTAAAAAAAAATTGTGAATTAACTAACCTTTCAGGTTCTAGAG
TAATTTATTAATCCAAATTGCCTTGAAGCATATTCCCATGCAAGTCAAGTTGAGGGACTTGATGGAGGCCATTTCTGAAATA
GAGTTAGGAGAAGTTATTTTCAGCCAACGAGAGATTCTGCAAGCTCCCTAATTTACCAATTCCCAATGGCAAGGATGAGGA
AAAGAGTTTATAAGAGATATCCAAGAATTCAAGGCTTTTGAAATCAGCAATGTTGTCAGGTAGTGTTCCTCATATGGCAAG
GATGAGGAGACTTTATTTCATGTAAAAAATATTTTCCTAGGAGTATATATATGATATATGATTATGTTGGGTCATATTTATGG
TATCTCAAGGTTTCAATTGACAGTTTTGGCTATCTCGGAAATTTTCCTTGTACCAAAATATTAACAATTGAAACATGTTTCAA
ATCCAGTTACTTTTGGTACCATAGAATTGAAATTAATTTATTTCAAATACATTGTATTCTTAATATATTAAATATGTTAATTT
GTTATTTTTTTAAAAAATAATCATTAGAAACAAGTTCCGGTATAGGAGGCATACTTAGTGTTTAGGCTAAGGAATAATGCC
ACCGGGTTCAGGAACAAGCCTGTTGAGGTGTCCCTTAACGTTCCGTGACATCCCCACTCTTGCATGGACATTCTGTGCAGAG
AAACGATGGGTGGATGGAGGTAAGATTGGGTGAGTTCTATAATAGTCACTGATGAGAACCCCAAGAGCAGCATTGAAGTTC
GAGGAATCCAAATAAGACCAGCGTAAATTATCAATTTCATCTCTTAAATAGTCACTAAAATAAAATATAAATTAATTCTTTC
AAGTATTGAAACATTCTTCAAATTAATCCTTATACATTGATAAAATATTTCAATGTATATATGCATTAATGGATATTTAACAC
TTTAGAAATTACTTATATATGATTTTGTTATTTTAAGGACTATTTATAAGAAAGAGTAATACTCTAGATATCAAATTGGTAGT
TAATTTAATTACTCTTGAAATAAGCATGCTCAATTTATAATATGTTGTTTTGTTGGCAATTAAATAAGCACACCCTCTCTAGA
ATGGTGTGTATGTACTTTTCTGTATATGTTGTTTTGTTTGTATACTTTTGCTTGCATAGATCCCAAAACAATTGGGTGATTTTC
ATTCTTCTATAAATTTTCTTATAAATATTTAAGAAATTTTTGCTAACACAAGACTGGTGATATGATGTTAAGATTGACATAAC
AAGGACGTGAGAGTTCAATTTTTCACATGCCATGTCACCCATCATAGTACCTTGTTGGCATGTATTAAGTCAACAACAAACT
TCCATTTTAACCATATCTTTGATCACCGCAAAAAATTATTAAATTTACTATTAAATTGTTTATATTTATTTTTCTTTATTGTTG
GGCTGAGATTTTTTAGTTACTAAAATTATAAAAGTTTTTTTAATCTCTGAATTTTGATAAATTGTTCTTTTTAGTTTCTGATT
TAATAAATTAATATTTTATAATAATTTTAAAATGAAAAATTCAATGGCTAAAAAATAAAAATCAATTAATGGTTGCTAAAAC
CTAAAGGATGTTGCTAATCAGTGCCCTAAGGCATTAGTTAATAAATTAAAATAAAAAAATATTTATTATGAAAATCATAAG
AGTATGTAAAAAAAATCATAAATAATACTATTTTATATATTTCAATAAAAAAATTATTATTTTAGTTCTTTATAACCAATTAA
TACCTTAAAAACACTAGTTAACATTTACCATAATTAAATTAACTAATTTTGAAATAAACTTCAATTATTCAATTATGTCTTAA
TAAGCTTGATTTTTCCCTTACTACTGCAAGTTTGCATCCTTTATTAAAGTGAAGTGATGAAATGTTGTCTGCCATTTACGAAT
ATCACTGAAATTAAAGTTGTTTTCTAGTTGAATTTATAATAAGTTTTTTTAATTGATAAATTTTAATCGTTATTTTGTGAGTTT
TTGTTAGTATAAGGAAGTAAAGTCACAAATTTTCTTTTCTTTCATAATTTTTTAACCATCCCATCAATATTATATCTCCATTTA
CAATAAGTTAATAACTAGCAAGATACCCATACATTTACGCAGATCGCTCTCCTTTTTTACGCATATTCAAAATACACTTGCT
TAAAAAAGATAATTAGCTATTTAGTATTTATATTCAATAAACATGAAAAAGGATTAGAATATTCAAGCAAAAAAAAATC
AAAATCCTAATTTTTAGGCTATTTAAATCATTGTCTTCTATTATTTGAAAATTGAAACTATTATTCATATTTTTACCTGTTTTA
TCTTCATAAATTCTATTTTAATATATTTATTATGTATTTATGTAAAAAAATCAACACTATTAAAATTAATTTAATTTGTGATAT
TATTCAGTATTTAATATTTTGTTATAAAAATATTTAATAAATTAATATTAAAATATTTCTTATATAATTATGAAAAAATGA
TATTTAAACTTATTTTATAAATATTAGTTAATAAAATTTCCATATATGAAGTTATTAAAAAAAGAGACAAAATAATATTTTGT
```

-continued

```
AATAAACATATTACCTAATTAGATTTAAATTAATTAATAGTATAAAAATTTCAACTACATAACATAAATTATTCAAAAAATA
TTTCATTCATAAAATTATTTTATACGGTTTCTAAGTAAAATTGATTTTATAGGATTTCAAATTTTTAAAAAGATATCGTGGAT
TCTTTAATATGTTGTTATGTTAAATATTCTTAAAGAAAAAGCTTTGTCACCCATAATAATTGGCCTGTAATGACGTTAAACAC
GTGATTGTTTTTCATGAATGATATTTTTGGTCTCTATCATAAAAAATATATATTAATTAAATGTATTATTGAGTAAGTATTTTA
AAAGTATTGTATTAAAAATTATATTTAATAATTAAATTTTAGTAGTTATTATATATTATGTAGAAGTGATTATAAAGTAAAAA
TGGGTTTTCAAATTAAAAAAAAAATATTATTTTTACTCTTTGATATACAATTGTGTTAACTACTAGGCGAAAGAACTGTGTC
ATTTGTAATAATTTTGAGTAGGATTATTTCTCATCAATGATTATTAAGATCCCTGTCATGATTAAAATGATTTTAATTTATGA
TATTATTAAGTTTTTGATATGAATTTGTGTGAAATACTTGAAGAAAGAGCATATTCAGTAAGTAACCTAAAACTATTTTGTA
ATAAAAATACATTTTATAAATTGATTTTAATATTTTTATTACTACATATTATGTAAAAATTAAAATTAATATAATTTATGATTT
TATTGAGTAAGTAATTTAAAATTATATTGTGATAAAAATATATTTAATAAAATGTTATATAATTATGTAAGAATGATTTCCAA
ATAAAAATAATATTATAAGATTTGAAAGTAAAAAAAAAAATACTATTTCAGTTTTTTTTATGTGTAGTTGTGTTAACTACTTG
GATAAAAAAAATATTGTGGTCTATAATAGTCTTTGGCAAGATTTTCTTGTCACTAATCATATTTGTAATCTCTAGCATAACTA
AAATTATTATAATATATGATATTATTAAGTCTTTTGGTATGTAGTTTTATAAAATATTGGAAGAAATAGTTTTGTTGCATATA
ATAATCCAATTTCGAGTAGGATTTTTTCTTATGAATGATATTTATGATTTCTACTACAAAAATATTTAAACTAATTAAGTTTA
TGAGATTATTGACGAAATGATTTAAAATTAGTTTTAATAAAAATATATTTAATTAATTAATTTTTAACATAGAGTCAAAACAT
TATTTTGTAATAAATTTGTTAACTAATTAAAATTAAATTTATTTATAGTATAAAAATTTCAACCTTATAATATAAATATTAAT
GAATAAAATATTTATTTATAAGATTATTTAATTTTATTTTATATGATTTCTAATTAAAACTAATTTTATAAAATTTCGAATTAA
AAATAAATTGTTGAGTCTTTAATATGCAATTGTTTTAATTACTCGCGAAAGAGTTTTTTTTTCCTATAATGGTTGGCCCATA
AGAAGAATTATTTTTAGTCATTATCCCAAAGAGAATAAAACTAATTTAATTTATGCTATTTCTTAGTAAATAATTTAATTTTT
TTTAAAATAAAAATACTAAGTGACTAATCTTCCTCAAGAATTCTGAGTGCACATAATTTGACTATTCCCCTCCCAACCCAAT
TTATTTCATACACAAGGATCAACGGGGACTAATATATTAATTTTAATATATCTATTATATATTTACTTAAAATGATTTTATAG
AATTTAAAAATAAAAATAATTATTATTGAATTTTTGGTTTGCATTTGTGTTAACTACTCAGGGTAGGAACATTGACGTCCATA
ATGACATTGAGTAAGATTGTATCCCATCAATGATATTTGTGATCTCTATCATATTTAAAATTATTTAAATTTATGATATTGTT
AAATCTTTAATATGTACTTTTATGTGTGTTTCGTTGCATTTGCACATAAGATCTCTAGTAGGATTATTTTACTTGAATCATCC
AAGGTTGTTAAACTCATGTTTTAAATCGTAGAATTGTATGATTTTACGATTCCACTAAGCTTCAGCGAGTTAAATCGAAAGC
AGAATTGAAAACGGAATAGACTCATCTGATTTAGCGCAAACTTGGGCGAGTTTGGGTAGACTCGCGAGTCTGCTACGAGTA
TGTGGATTTACGAAAACCCGAAACGGTGTCGTGTTGTAGCTACTTATTTGAGTAGACTTTGTCTACCTTGTTCGAGTTATGC
AAAGTGCAAAATTGTTTGGTTCATGCTTCTTGGCTTCTTGCTGTGATGCAGTCGGTGCTAGAGTGCTACGGTGGGGTGCGAC
GGTGAAAGGAGGTTTTCGGTGTTGGAGTGCGACTGTGCAAGTGTGTGACACAGTGCTTCTGGATCTTTTGTTGGAAGGAGGT
TTTCAGTGAAAGGAGGTTTTCGATATATGGGATCAAGGTGATTTGTTGCGAACAAAAGCTAAACTTCAAATTGCACAGGGC
CAGTTAAGGAACAAAAGCTATACTGATATACGCAGTTGCTAGTTGTTCTTCAAATTCAGAGTAAAGGTTTTAATTTGGTTCT
GGGAAGAAGCTATACAAGGTTTGTTGTTGTAATAACTTATGCTGATTGAATATTTCTGAACCATGGGCCTTTATTCCTGTTAT
TTACTGTTAGAATTGGATGAATGCAGTCTCATGAACCTTTTGAATTTATTAGATTTTTCAAGAAATTTGTGATCATGGGTTTG
TTAGAAAAAGGAAGTGTCCTGATAGTTTGTACCTTAGAAAGTGAGAATATTGATATATAGGAAAGTAATAGTGAGAGTAT
TGAAGATTTGATCACCATTTTATTTGGTTTGAAATGGAGGCATTTCGTGAAAAAGTAGAGTGCAGAATGCATAGAGTTCCTC
AGAATTTCGCATGTGTTGATGAAGCTTTTTGAAGCATGGTACACCTTTAAGGGCATACTACTGTTGGGTTCATATATTTTTG
GTTTAATGAGAGAATTGAAGATTTGATCACCATTTTATTTGGTTTGAAATGGAGGCATTTCGTGAAAAAGTAGAGTGCAGAA
TGCATAGAGTTCCTCAGAATTTCTAACATACTACTGTTGGGTACACCTTGAAGCATATTCCCATGCAAGTCAAGTTGAGGGA
CTTGATGGAGGCCATCTCTGAAATAGAGTCAGGAGAAGTTATTTTCAGCCAACGAGAGATTCTGCAAGCTCCCTAATTTAC
CAATTCCCAATGGCAAGGATGAGGAAAAGAGTTTATAAGAGATATCCAAGAATTCAAGGCTTTTGAAATCAGCAATGTTGT
```

-continued

```
CAGGTAGTGTTCCTCATATGGAATTGTTGGACAAGGAGGGTTTCACTACTGACAAACTGCTAACTCAGTTGGAGAATGTTGT

GTAAGTGTTAATGCAAAGGACAATACCGAAATGCATGAAAAGATCATCATCTCATAACAGACTCTTTCACATACGACCGAC

CACCTCAACTGCAATGGCATATTTTGGTGAACGAAATTGTTCTGACTCACGTAGATTCAAAGTGAATATTCATAAATCAGGC

ATTTTCTTTGCTTTGTGACAATGTCCTAAACCTTCAATTAGTTGATCTTGTTCTAGCTCTATAGGGTAATAAAAGTATATCA

ATGTCTGCAAAATACATCAATAAGATCAAGACACCAAAATATATATATGTGCTTGAATTATTTATAAACTTTTATTTTGATTC

CGGGTTACAACTTATCTTAAAATATTTTCTTTTTTCTCTGTTTCTTCTTTCAAGTTTTTAATTTAACTTCCTGGGTAATCTAGA

TTCCATAAAATACTTCTGGAAATGCAGATATGATCTTGTTTTTTTTTTTGTATTTTACTATTCTATATATTTTATATTAGTGTT

GTTTATTTTCTTAAAATTATCATACATAATTATATATGCTATATACTTGTTGATAGGGAAGAAGATAGAAGCTGGTTTTCAAG

GACCAGGGCCTCCACGGAGAGAAGAATGAGAAGAATAAGGGAAGGAACAATTGTATATTCCATTGATTGATGTTGTTATTA

CATAGTATTATTTATACTGATTTCTCAATAATCGAATTTGTCTTTTTGTGCTACAGAATATCAGGAAATTGTTAAGTTTGTCT

ATTCCTACCCGACCAGCATCATTCTTCCAGATATGATGCACCTGCTTGTTTCACACCTAATCCTTGAGGTAAGTGGGTCTTG

TAATTGCTCTCTTGGTCTTGTTTTCTAATTGCACCCCCTTGCTTCTGTTGCTTGCTTGCTGCAAGTTCCCACTGATTCAAATTC

CAACAGTTCTGCAAATAAAATTGAAGAAGAAGCTAGAGGTGGGAAATACTCAAGTCATTCTCTTGAAAAAGTTGCTGCAAT

GATATGCAACAAAATATCACTATACGGAGTCAAGGTAATTATTGTGTTCACATGAACATTTCTTCCATGAAAATATATATTT

TTTTACTTTGTAATCTCTTTATAGTATGCATGGAAAATTAATTTTCTGATTTTTTTCTCTGTAGTGTTATATATTATTTTTAATC

ACATTTTCTTATTTATTAGTTTGTTTCTTATTTGACATCATGTAAATTTGGAGATTTGGGTTAGAAATGTTTTTGGAATTTTCC

TGGTTAGAACTTGATAGGTCCATAATGAAGGTATATAAAAGGATAGGGAAAAGAGGGGGTGGGGAATAGAAAAAGAAAGG

ACAAATGGGCCTCAGAAACAAGACATGCTTGTGTATGACAGCAGAAAGAATCAGCCGTACAAGTTGCACTAGCTGAAGTG

GAAAAGGAACATAGGTTGGCATAATGGAATGGATAGCATTTGATCTTTAATAAATTTTTGCTTTGTAATAGGTTCCTAATAT

TTAAAAGTTTTGTTTGAAATACTTATCATTAGTCAAAATCTGTTATTTGCTCACACGATCGTTAACCAGCCACACAGACAT

GTCATGTGTGATTTTTGTCTGACTGAGATTAGGATTAATGATAAGAAACTATAGTCAAAATCCCTTGGGCATAAAAGAATCA

TTCTTCAGCAAATAACGGATTTTGACTAATGATAAGAAACTATAGTCAAAATCCCTTGGGCATCAAAAAATCATTCTTCAGC

ATTCCTCTACGTTTTCACACAACCCATTATAGTTTCTTCTATACCTTTCTTATGGATTTGTCACTATGACTTCGTCACTCGTGA

AGATCCAAGGTGAAGAGGTCCTCACCAACGATTTTTAGGATCTTGCAATCAATTTTACATTTTCAAATCAAACCAAGCCAAC

TCCCAACTCAAGAAATTCACATGGATAAGGTTTCTAAGAGAACACATCAAAATAGTTTCATGGGTAGAAGAAGGTCAACAA

AACCTTACCCTAAAATGCGATTCCGCTCGGTCCATTGCATAGAGCACGAAAAAATGAGTGGGATAGCGATGTCTGAACTTG

TCGTCGACCTTTCATAGTTGCGAGCTCTTTTTGCAAACCCTTGCTTTCATGGTTGTCTCTTCTTGTTCTCCCTTCTTAAAGGTC

ACCACCAACCCAGCCATCGGCCACCACTGGTGTTGCCAGTCGTGCCACTGCTCGTGCCAGCGCCAGCTACCACCAGTAACT

TCCTTCAACTCTCAAACCTCACTTCTCTCCCAGTCTCTCTCTCACACTTGGCCCTCAAACTCACTTGTGTGTCGTAGGTGAAG

AGAAGGAAATGATGAAAACAAAGAGGAGGGTTTTCTTTGGGGAAGGGGGGTCCATGAGTGATTTTTTAGAGAAGGAGATTT

GTTGTTGCCATGGGAGCCATGGTTCAAGAGAAGAAAAAAAGAAAATGGGTTAGAATTATTGTTGTTGCTGCCATGGGG

TTTCAAGGGAGGTTTGGGGGGTTTTGGAGACACAATAGCGGTGGTGTGGAGCTAGTGGAGGAGTTGGTTGGGGACTGGTGG

GGGTGGTTTGGAGGATTCGGGGACTTAATGATGTCGTTTTTTTACTTTTTTCTATAAAAAAATAAAAAATCTTACGTGATCGG

TTATCGATCACATATGAAGATAATGGATTTCGACTAACGGCAGGAACTTCGAACAAAGCTTTTTAAATATTAGGGACCTATC

ACAAAGCAAAAATTTATTAGGGACCAAATGCAAAAAATGAGTATTTATCAGAGACCAAAAATATATTTAAACCATTACCTA

ATTGCAACTCACTATGTGATAAGTTTGTTGACTTTTAAAATAATTATTTTAAAGTAATTCAAACAATAATTTATAATAGTGTA

AAATCATTTTACATCATCAATACATAAGTATTAAACTCGATATCTCTCTATATATTTTCTGTTCGAGATTGATTGAAATTA

TCTTATTTGCTTAACATATTAAAATGCGTCATTTTTAATGATATTATTGGTCTATAGTTTTTATGTAATACATTTAATAATGTT

TAGAAATATTTGTATATAAATAACTTTTATCTATTTTTTCACCAGAGCCTATGAAATGTAAGCACAGGTTTGTTAATGAGTAG

CACAACATGGACAGTTTGTCAAAGGCCCAATAGCATCTTTAATGGGATTCTTGAACTCAAGAACCCTATCCACTAGATCTA
```

-continued

```
CTATTATTCTTATTAAGAGTTTTTTAAGATGGAGATTGGGTTCTAGGAAAAGAACTACTATTTTTTCAAAAATATTATTTTTT
CTTGTGCTAGTAAAATCTAATAATCCAAATTGGATTCTACTATTAGAATAACAAATGATAGAAGTTCTTGCATCCTATATAA
CATCATGGGACTCACAAAAAATAATCCAAGAACCTAAAATGGATTCTTTGACAAAAATGTTCTAAGAATCTCAATATTTTCC
CACTTAAGAAATATAACTATCAAATCAATATAATATGAAACGAGTTCAATCTTTATTGATTCACTTGACGCAAGCTATATGC
ACAACTGACATAATAGATTTTAATTCTAAATAACATGCAATAAAAATATAACAAACCTGTTCCGGAAAAAGCCTCCTCAAA
ATGAAGCACATTCAGTCCCCCCACAATTTTTACAAGTTGGGGTCTTTATGCTGCATCAAAATATTCCATCATATCCCGCAAA
TGTTTCGTGCTATTAAGTTTATGTTAGTTGTCCCTTCATGATGCATCACCAGCATATCATAAACAATCAGTTAATCCCTTATT
CTGCCGAAATAGTCGGATTATCGTCAATCCCCCTTAAGGTGGTCGTTTGATCCCGCTTGGCAAGGCCCAACTTTGAAAGTGA
ATTGACCTAAGCCTCTTTTATGGGCTTGATGCGTGATAGAAGATCGGAACATAATCCAATACATTCCAATCTGAACCAAAA
GATAACCCCTTAGCTTCAAGCACACAGTGCGTAAAAGCTAAAGATGTAGAAGATCGGAACATGATCCGATCTAGACCAGA
ACAAAACCTAAAACCAAACTACTAACTGATCTATAATTTTTTATACATCATAAAACTAAAAAAACAAAGCAAACTAAGCAC
ATAATCTTACAATCCCTACTGAATTTACTAAAAGAGACACAGATAGTTGAGGTGGGAAATGTTGCCAAACCAGAAATGAAT
TATCACGGGAAAGTATGGCTGATGTGGTTACAATTAGGAGTCTTAATTCATCTTAAAGCATTAATATTTTTTAACTTAACAA
ATATAATTAAAGAGAAGTAACGAATAAGATAATGATCTAAAATTCTTGTATTGATTGAAAATAGCGTAAAAGATGTTTCA
AAGATAATGATACAAACTCTTTAAATGCAAATGGTTACATGCACAAAGCACGTATATATATATATATATATATATATATATA
TATATATATATATATATATGAATATATCTACGTACATTCATATATGTATGTATATGCAAACATATATACATGGATGCATAT
ATATATATATGCACTAACAAACATATATACATCTGGATAGAGAGAGGATCAGAATAGCAGGACAAAGACAAACTTGTATTT
GTTGCTTCCATACTAGAATTGCATTTTCTTCAGGGTTAGATGCATCAACTGTGTGGGAGGGAAATTTATTAACAGCGCTAAG
TATTCTCCTAACCTTAAGCAGGATCTCCTTCTGGTCTCTTGCCATCTGAGCTTGCATGTCAATGATGAAAAACCTGACAAGC
GAGTCCGCAAGTGCCTCAAGTTGTTCCTGGTAACAAGCTTTGTCGCATTGACCGAAAAAACCAAGGTGACGTTGACCAAAA
AATAGTCCTGACAAGATGTTGGTAAAAAAATATAATCGGTTGATATCGATCACAAACATCATTGACTAAGGTTAACAAAAA
AATTTCTAACCGACATTGATCAAAAAATAACTTCGACCAAGGTCGATCAAAAGAAACGTAACCGATTTCGGCCAACAGAAA
TATTTTATATGATAGCCTTTAGTTGCAAAAAGTGTGAACCAGGGGGTATTTTGACAGCCGTAAAACATATCTCATGGCAGTG
GTTGTTATATAAGGCAAAAAACCATGAACTTTCTTCTCTTGCTGGTGTTTGGAGCCACTTCAAATGTGATTGATGTTAGAGA
AGTTAACAGTGGCATTTTTAGGACTGAAAGTTAACTTAGGAGAAACCATTTTTTTATGTATGTAATACGGTAACACATGTA
CCTCTTGCAGAGATTGGGGAGAAATTGCAACTTTTCTTTTTACATTTTGCCTTAAAAAAAGTGTTCATATTTATAAAAATAAT
TTTCTATTTAACTTGGATATTTTTCTCATACTACTACACTAAGGTATATACAACCTAAGGCGTGTTTCTTAATTTGGAGAGT
GATGCTTGATTGATTGACTACCAACGAAGGATAATCTAAAAAGGAGAAACACCATTTATAATCCTCATGAGTGCTTATGTC
CCTTTTGCCTTGAGGTAGATGAGTCGGTATCTCACTGTTTCTTCTCATGTCATAAAATTCTTGGTACTAATTTGGAGGCAATG
TTACTCTTGGCTGCTGGCTGCATGTAAATGTGGTGTTGCCACAATGACCAGAATCACATTTTTGGCAAGATTCTGTATTCGT
AAGTTCAAAGAAGGAGGCAGATGTATGGAGGGCGGTGTGGGCATCAGAAATTTTGGTGTGTATGGAATGCTAGGAATGAGT
GTATGCTAAGGAATTAATGGCTCTTTCAATGCTGAGAAAATTACGCAGAATATATTATTCTTTGCACGATCGTGGATTAATA
AAAGCCAGAGTCCCTAATTTTAATTATTGTTTTACTTAATGATATATGGCACCTGGAGCTTGTTTCATGAAGAGACAATTTTG
AATGAAATGTGAAGTTAATTTGATTCGGTGGTAGCTGCTCTTCGAGTGGGATCATCCCAAATGCAACCGATGTTTATGTGCA
CGATGGTGGGGCTGGTTAGTGATGCCGCATCAATGTTGCATGGCTTTAGACATGATTTTAAATTGCAATTATGATTGCGTT
GCATGCAACGAACCTAAAAATCTTACATTGTGGATAATTATGGAAAAATACAAACTGATGTGATCATAATTATAATTGTGAT
GTGATTACAGAGTCAAAATACATTAGCGTTATGACTGCAATTATGGTTGCTGACTACATTTTAAAACCATGACTTTGGGTGT
AATGGTCCATGTTCGAAGCTAGCTATCTTTCTTTCTACTGTCACTGGTGTATATGTTTTTGGATCTTAGGTAATTTTGGTACC
ATTTAATACAAATCATTTTGTTGGAAAAAAAATACGGTAGCCTACATGCAATATACAAAATAAAATTGAATTACTATATATT
ATCATAAATAGTAGAGTATAAGAAGTAAAGAAAATTCTAAAGATAAACATGCATTTAAAAACATATGAAAGAATTTTTTAA
```

-continued

```
CTATATATATAACATCTTTAATTAGCTTAATAGAAATGCGAAAGTACAATAAAAAAGCAAAAACATAATAGGCGTGACAAA

TCGGTTGCTTATATACAATAAAGACAATAAAGTTTGAAACTAAAACCTTATCCAGACTATCCAAATATCCCTAATAATCAT

GAAAAAATTAGAACAGAAGACATTTAATAACTATAGCAACAGTAACAGCAGCAGCTATAGCTAATGGCGCGATCACCGAA

TCGGAAAACTTTTCATCATTGAAGTATTCTATTTCACTAACCCTAAGCAAGATCTCAAGTTGATCGCGTGCAATAAGAGCTG

GCATTTCAATATTGAAAAACCTCTCAATTGAGTCTGCAAGATCTTTAATTTTAGTTTTCCACGGTAAGAATTCTTAGCCACA

AAATTGTATTTCCCTATTTTTGAACACTTGTAAACAACCTCTTTGCTCTTCCTCAATAGTTGTATCAGTGGCTCAAGTTCCTG

CTGTGAACGACCCAACATATTCCTGTACTTACCTATCTCCTGCCATGTTTACGCTACATATTTTCTAGAATGTTATTTGAATT

TCATTAAAAATCATAAGAAGCAAGTTTGAATTTTTCAGTGAAATTTTTACTTAGGTTTAGTTAGACAAACCCTATTTAAAGC

TATATTGTTTTGCTTATCGGAACCAAACCAATTAGTTCGGTTTGAATTTCTTAGTTAAATCAAGTCTGGCTTAAACCAAATCG

AGCTAACCCTAGGTTAATTGTTTCAAAGGTCGGGTTGAAGCTCTTTAAACTTGAGAATGTGTTCTACAAACCGAAGTACCTT

ATTATTTAAAGAATATCTAATATTTTTTGTTTTTACATTATTGTTGAATCCATTTTATATGATTTTTTTTTACAAAATATTAA

ACTTTATTTACTAAATAAGATTTATATAAAATTCATGAAGGTAAAAGTAATATTTTTATCTTTTAATGTAAGGCTTGGTTTCA

CTTTCGTCCTTCAACTTTTTTTTATTTGATTTATTTCAGTGATCATTTAATATTTATGGATTCTTCCTTAAGGAATCTTGATATT

TTTCTATAGTTTTAATTGTTCTTCGGTTATTTATTCGGAAATTGAGAGGGGATCATCACCTCCAAAGATTTCCTCGCTCCCAT

TAACAAAAATGTCTAAACAATTACCTTCCTTCTAAAATTTTTGTGAAGTACCTCCACTAATTAAACTCAACATATTCTCCCA

AACTTCATTTTCTTTGAAAACAATGTTGTCTAATTCAAGACGCTTTGATATAAAATATTTAGTCGCTAGAACGAGAAAAAAA

ATTGAATAAAAGAAGGGATTTTTTTCTTCTTAATGTACTTCATGCTACTTATTTGTTGGCAATCATTATTAATATATATTAT

CTTATATGAGACAATTTTCAACATTTAAATGTTAATTTTGTAAGTATCTTGGTAGTATCCTTTTTTGATAAGGAATAGATATT

ATTTTGAGATTATATTATGATGATGAATTGTCTCATAAAAACACGAGGCAAGCACTTGAAAGGAACAAATTCTCTAATTTCT

TAGTGGGTAGTGGGAGAGAGGAAGTAAACTTGCTTCAATATGCAAATGACGCTTGACGCACTCTTTACAGGAGAAGCAACC

ATTTCTAAGGTGCTTACCATAAAAAGCATTTTGAGAGGCTTTGAACTTGTCTCGGGCCTCAAAATGAATTTCCATCAAGGCT

TTTGTGGTGCCTTGGGAGTGGATATTGATACCTTGATGAATTATGCAAGCTTGTTGATTTACTTGAGACAAACTATATGCAC

AACTGACAAAATGGACTTTAATTCTAAATAGCAATAAAAAGATATATAATAAACCTGTTTCAGAAAAGGCTTCCTCAAAAT

GGAGGCTACTTCAATCTAGTACGGTAGTTGACTTACTAAGTACGAAACAACAAATTATTAAGTTGATAATTAATTAAACATG

ATTTTAAATACTTACATATTTATTCACATGTAACTATAAAGATTTAGTAAGAGCATAAATAAAAAATGTTGTTATAATATAT

AATTTTAAATTTAATATAATAAAAATGTGTTTGCAAAATAGAAATATAAATATAAAGCGTGACAACACATGTTTTTCGTTAA

TAATAATAATAATAATAATAATAATAATAATAATAATAATAATAATAATAATAATTACAAATGGGTTTTGACAAAA

TCATACCTGGCGAAAATATGCAGTTTAGTGACGGAATTAATTTGTGATTCATGCAATACAATTTGTACCAATCATCATCATC

ATCATAATCTCTTTTTCGTTTTATTTATCAACGTTGCTACTTAGTACGAAAATTATTTGCACAAAATACAAACAGAATGATGC

TATCTGTTATGAAAGGTAAATCCACACGAATTACACGAAATATAGAATGGACGGTTATGATTTTATAAAATGAATATCGATT

AAAAAAATTTAAAAGGCATGTAAAAAGAGATTTACAGACATCAAACTTCGTGCGACTTTTACAAAATCCTCTTTCCTAACA

CAGCATTATATTTTCCATACACAAACCGTAAACTATAGATTCTAAAGGGTATACCTGACTTATTAACAACTTTTTAAAAACT

AATATTCATTAAAAATACCAAATAGGTTTTGACATAATCACACCTCGTTGCAGATTTGACAAAAAAGAATTCTACCAATTTA

TTTTTCGTCAAATTGGTGTTAAAATTAAATATATGTGACTAGTCAAGTAGGTGATAACAAGTTGCAGCACTTGTATATATGA

GTGATGCAAAGGATTCGTGCAATTTATTTACGAAAATTATATATTGGCATGAAACACACGAACTGTAAACTATATATAGTCA

CTAACTTGTATACGTACGAACTGTAACAATAAATTTTAAAATAAAATATTAATTACAAATATAAAATGGGTTTTGACAAAAT

CGATCACACCTCGGGCAGATTTGACAAAAGATAATTCGCCACGAATTCTTTTTCGTCAATTATTTAACACAACCTTCCTTTT

ACGAATTGCACAAATCCACTTTTAAAATACAAGAAAATTTTGTTTTAAAAATTCAGCCAGCCGACATAGAGGTGTATGCAG

GTAAGTTTGGATTGAGTTTCATCATACCTATGACTTAAGAATGAGTTGATTTGAGTCATTTGTATACGATTTTAATTAAATTA

TTGGGTTAAAATATTTAAATTTGTATGCTATTTATTAAATCCAATATTTATATAAGCTAAAATTCTTATTAATTAGAATACTG
```

-continued

```
AAAACATTACTTATAAATTAAATATTGTCAGATGCTGCGACTAAGTGAGGTGGTGGAAAGATGTCAAGAGTTGAACTCTAA
TTTTTGAAAGAATAACAATGACACTCGGTACTTATTCAACTCTCTTGTTATGCACGAAACATATATTTAATAATAAATTCAC
GCGCGTATTTATAAAATTATATGAGAATTTTTTGTATAAAAATTTAAACACATAAATTATATTAAATTAAAATGTTATGGTAA
TTTTAAAATATGAATGATAAAATGATTCAATTATTATACTTTAATTTTTAAATAAAAATTGATTTTTATAATATTTAAAGTTT
ATAAATAATATTTTGAATAATTTTACATATAAATTAATTAAATTAAATGCAAAAAACTGAAATTAAATATTTCTTAAAACTA
ATTAATTATTATATGAATCACTTTATATTAGTAATTGCGAGCTGCTTGTCTCTTCTCTCCCAACGGCTCCCGCCATTCAAAGT
TTGGAGATAATTAAAAGCAATAAAGTAGCACTGCATTCGTTACCTCTCTTGGTAGAGACTATAGAAGTAGAAGGAAGCTCA
AGGGTTTTTATTTTAAAAAATATATAAAAAATGAATTTAATAATTTTTTAAATTAAAAAATAATAGGAGCAAAGAGAAGTT
GGGTTCCCTAACCCCGACTTCTCTCTGCAAGCTAAAAAGGAGTGTTGTTTAGGAAACAATTTTGAGGCAGGTGTATTTTGAA
AAAAATTGAGGAGAGAGCAAGTGTAGTGGAGTAAAAAAATCCTATAAGATTTTGTTTGATACTAAAAAGAAAAAAATAATT
GTGATGAGAAAAATAAGTTAGAGGATAAATATCTTCAACACTTAAACAAACAAATAAAAAAGTTTTTCTAGAAGTTCAC
TTAAATCTATTTTCACTATTGATAAAAATTTATACCTGTTGATTTAAAATAAAATTATATTTTATAAAAATTATATTTATTAA
ATATGATAGGAGAAAAATATTTTTTACATATAGTAAAATATTTTCATTTGCTGGACTTAAATTTTCTTTATCTCTCATTTTAGT
ATTGTTGTTTGAGATGATCTCACTAAATATATTTTACTTGACTAATAATAAAAATTTTATATAGATAAGATTCAAAGGATAAT
CACCAACCAAAAATTTTTATGGAAGTATTTATCAAATAATTACAATAGATATATAACATAAAAAAAGAGTTGAATTGAATA
ATAATTTTTCATGCCAAATTACTTTAATCACTCTATATTATTATTATTATTATCATTATTATAACATCTTCACAATATTCTTTA
TTTTATTAGTATCTATTATTTATTTTATTAATTTTATTTAATAAAAAATCACAAACTTTTCTTTTTGCACACATCTTTAACGTA
CATATAAAGATATTCAAATCTTGAATTCATTAATATTATGTTTTTAGGGATCAATTAGCATGTGTCCTTTCTTTAATTCTTTCT
CTTTTAATTTGTTCAACATTTTTTTTGTCTTAATAATTTTTTAATCTCATTTTTTTATTTTCCTCCTAACAAAATTTATTCTATA
TATAAGAATTAATAAAAATTTAAATCTTTTACCACTTGATTAAAAAACATAAATCATTATCAATTATTTTAAATTTATAAAAT
CATGATTCAGTATTAGATCTTTATAAAATACCATATCTCTATGACAATTTTAATGATTAGGTTGAAATATAAACTAACACGA
ATTTAAGTAAATATTTCACTATTTACTTTCACATTGAAAAATTGATTTTAAATTTTAACTTTAGAAAAAAAATTCTAAGTTGA
GGATCTTTACATAACTTTTGGATTTAACAAAAAAATTCATTTTCAATTTTACTATTAACTTATTTTTTAAATAAAAATATCCA
AAACACATGTGCAAACTGCTTCAATACAACTTGTCTCACAGCATCAAAGCACAGGAACATAATTATGCACAGTACCCTTGC
AGCCATCCACACATATCACCAAGAAAAAAACACACACCACTGCTCCACACGGTTTGGAAAGCGAGAAAGCTGGCCATCAC
TAACTTTAATTATAGCATTTTAGAAATATAATCCATTTTTTTAAAATTAACGGTAGAAATATCATCACTCTTTAAATCTCTTG
AGTCTTTAGTTTAGAGGAGCTAAATTTAAAATAGAAATATCAAGAAAGCAACATGTGGGATCAAAAGTAAAGAGACTCCC
AACGTGATAAGTCACCCACCACCAATTCCCTTGCCTTTTGTCTTGCACAGCAGAACGAGTGAAGGTGAAGAGAGTTGACTT
AAGCCAAATCTCATCACATCAGTTCATAGCAACCAATTCCCTTGCCTTTGTCTTTCTACTCTGATCATCTTTTGTTCTTGAGA
TAATGGCAGCAGCACTGGTCGGTGGTGCCTTCCTCTCTGCTTTTCTTGATGTGGTTTTCGACAGGCTGGCTTCACCTGAGTTT
GTTGACTTGATCCGTGGAAAGAAGCTTAGCAAGAAGTTGCTTCAAAAGTTGGAGACCACTCTCAGAGTGGTTGGAGCTGTG
CTTGATGATGCCGAGAAGAAACAGATCACAAACACCAATGTCAAACACTGGCTCAATGATCTCAAACATGCTGTCTATGAA
GCCGATGACTTACTCGACCATGTTTTCACCAAAGCTGCCACCCAAAACAAGGTAAGACTTGTTTTCTCGCTTTTCCGATA
GGAAGATCGTTAGTAAGTTGGAGGACATAGTTGTCACACTTGAGTCTCATTTAAAACTCAAGGAGAGTCTTGATTTGAAAG
AGAGTGCAGTGGAGAACTTGTCATGGAAAGCTCCATCAACATCTCTGGAAGATGGATCTCATATATATGGTAGGGAGAAAG
ATAAGGAGGCCATAATCAAGTTGTTGTCGGAGGATAACAGTGACGGTAGAGAAGTGTCTGTGGTTCCTATTGTGGGCATGG
GTGGGGTTGAAAAACTACTTTGGCCCAATTGGTGTACAACGATGAGAATTTGAAACAGATATTTGATTTTGATTTTAAGGC
ATGGGTTTGTGTTTCTCAAGAATTTGATGTTCTCAAGGTCACAAAAACTATAATAGAGGCGGTGACTGGAAAGGCTTGTAAA
TTGAATGATCTGAATCTACTTCATCTTGAATTGATGGACAAGCTGAAAGATAAAAAATTCTTAATTGTTTTGGATGATGTTTG
GACAGAGGATTATGTTGATTGGCGTCTTCTTAAGAAACCATTTAACCGTGGGATTATTAGGAGAAGTAAAATTCTTCTAACA
```

-continued

```
ACCCGCAGTGAAAAAACAGCATCTGTAGTCCAAACTGTTCACACCTATCATCTAAACCAATTGTCGAATGAAGATTGTTGG
TCAGTGTTTGCGAACCATGCATGTCTTTCCACGGAATCTAACGAGAACACAGCAACACTAGAAAAAATTGGAAAGGAGATT
GTTAAAAAGTGCAACGGACTGCCTTTAGCAGCAGAGTCGCTTGGAGGCATGTTGAGAAGAAAGCATGACATTGGTGATTGG
AATAATATTCTCAATAGTGACATTTGGGAACTTTCTGAAAGTGAGTGTAAAGTTATTCCAGCACTGAGACTTAGTTATCATT
ATCTCCCTCCACATTTAAAACGATGCTTTGTTTATTGTTCGTTGTATCCACAAGATTACGAATTTGAAAAAAATGAATTAATC
TTGTTGTGGATGGCTGAAGATCTTTTGAAGAAACCAAGGAAAGGTAGGACTTTAGAAGAGGTTGGTCATGAGTATTTTGATG
ATTTGGTTTCGAGATCGTTTTTCCAACGTTCAAGAACAAGTAGTTGGCCTCATCGCAAATGTTTTGTGATGCATGACCTCAT
GCATGATCTAGCCACATCACTCGGTGGAGATTTTTATTTTAGATCAGAAGAACTTGGGAAAGAAACAAAGATCAATACCAA
GACTCGTCATTTGTCATTTGCCAAATTCAATTCTTCAGTCTTGGACAACTTTGATGTTATTGGTAGAGCAAAATTTCTGAGAA
CCTTCTTGTCCATTATCAATTTTGAAGCTGCTCCATTCAACAATGAGGAGGCACAATGTATCATAATGTCGAAGCTTATGTA
CTTGAGAGTTTTATCATTTTGTGACTTCCAAAGTCTGGATTCTTTGCCTGATTCAATAGGTAAATTGATCCATCTGCGCTATT
TAGATCTCTCTTTTTCAAGAATAGAAACACTGCCAAAGTCATTGTGTAATTTGTACAATCTGCAAACTTTGAAGTTGTGTAG
TTGCAGAAAGCTGACTAAGTTGCCCAGTGACATGCGCAATCTTGTTAACTTGCGTCATCTTGGTATTGCTTATACTCCTATA
AAAGAGATGCCGAGAGGAATGGGTAAATTAAATCATTTACAACATCTGGATTTCTTTGTTGTGGGCAAGCACGAAGAGAAT
GGAATCAAAGAATTGGGAGGACTTTCAAATCTTCGTGGTCAGCTTGAAATTAGGAAGTTGGAGAATGTTTCCCAAAGTGAT
GAAGCGTTGGAGGCAAGGATGATGGATAAAAAACACATTAATAGTTTACAGTTGGAATGGTCTGGATGTAACAACAACAGT
ACCAACTTCCAACTTGAAATAGATGTGCTTTGCAAGTTACAGCCTCACTTTAACATTGAATCGTTGGAAATAAAAGGTTATG
AAGGAACCAGATTTCCAGATTGGATGGGAAATTCTTCCTACTGCAATATGATTAGTCTAAAATTGCGTGATTGTCACAACTG
TAGTATGCTTCCTTCACTTGGACAACTACCTTCTCTCAAGGACCTTGGAATTGCACGATTGAATAGGCTGAAGACTATTGAT
GCAGGTTTCTACAAGAATGAAGAATGTCGTTCTGGGACGTCCTTTCCCTCCCTTGAATCTCTGTCCATTGATGACATGCCTT
GTTGGGAGGTGTGGAGTTCCTTCGATTCAGAAGCTTTTCCTGTGCTTAACAGTCTTGAAATACGTGACTGCCCCAAACTAGA
GGGAAGTTTGCCGAATCACCTTCCTGCTCTGACAAAACTTGTGATTAGAAATTGCGAGCTGCTTGTCTCTTCTCTCCCAACG
GCTCCCGCCATTCAAAGTTTGGAGATATGTAAAAGCAATAAAGTAGCACTGCATGCGTTTCCTCTCTTGGTAGAAACTATAG
AAGTAGAAGGAAGCCCAATGGTGGAGTCCGTGATCGAGGCCATCACTAACATCCAACCAACTTGTCTCCGGTCTTTAACAT
TAAGGGATTGTTCGTCAGCCGTGTCATTTCCGGGTGGTCGTTTACCTGAATCACTGAAGAGTCTGAGTATCAAGGATCTTAA
AAAACTGGAATTCCCGACGCAACACAAACATGAGTTACTGGAAACACTGTCAATAGAAAGCAGTTGTGATTCACTCACATC
TCTTCCATTGGTTACCTTTCCAAATCTCAGATATCTCAGCATCGAAAAGTGTGAAAATATGGAATATCTTTTGGTTTCAGGG
GCAGAGTCATTTAAGAGTCTGTGTTATTTGTTAATTTACAAATGCCCCAACTTTGTATCATTCTGGAGAGAAGGATTGCCTG
CGCCCAACTTGATTACTTTCAGTGTTTGGGCTCTGACAAGTTGAAGTCGTTGCCTGATGAGATGAGTACTCTTCTCCCAAA
GTTAGAAGATCTCACCATATCCAACTGCCCAGAAATTGAGTCCTTTCCAAAACGGGGTATGCCACCTAACCTGAGAAGAGT
TGAGATTGTCAATTGTGAGAAACTACTGAGCGGCCTAGCATGGCCATCCATGGGCATGCTTACTCATCTCAATGTTGGGGGT
CCATGTGATGGCATCAAGTCCTTCCCTAAAGAGGGTTTGCTGCCTCCCTCCCTTACGTCTCTGTCTCTATATGACTTGTCAAA
TCTGGAGATGTTGGACTGCACGGGCTTCTCCATCTCACATCCCTGCAACAATTACAAATTTTTGGATGTCCAAAGCTGGAG
AATATGGCTGGAGAAAGTCTTCCTTTCTCTCTAATAAAATTAACCATGGTGGAATGTCCTTTGCTGGAAAAACGATGCCGCA
TGAAGCACCCTCAAATTTGGCCTAAAGTTTCCCACATCCCTGGCATTAAGGTTGGCAATAGATGGATTTAGCCACCAAGGA
GGACCAACAGGTATCTTCTAAGTCTAACCAACTAGAAAACTATTTCTGTCAAGGATATGTTTCATTTCATGTCTTTCTACTTT
TACGTTTTACTAAATCCAATTCATTCTGAAATGGAAATTGACCTTGTATATATGTTACTGAATCTACAGAGAATCAACAAAT
CATCAAAGGCAACGTGGAAATTGACCTTGTATATATGTTTCGAAGAAGTAACGATACAGGTACTAAGTAACAACATTGACA
AATACTTAAATATAATGATTCTCCGGAAAAATGTTACACATCAGTGTTGTTATATTCTAACTTAATTTCTCCTTAAGATTATT
GAGGCCAGAGTGAAAATGACCGTGGGAAACTTATTTTTGTTTTTCAGATATGGTTGATTGGCCCGGAGAAACTGTACCTACC
```

-continued

```
CATGAATCTAAGTTCAAATTTGAACTAGTGCTAAATGTAACTTTTAATTTAATTGATGTCAAATTGACACTTTCTCAATAGCT
GAATTTTTATTTGTGAGGTTTTTCGTTGGGTACAATGTGAAGGATGAAAAGGTGTACCAAGTGAACTTTAGAAGGATTGGAT
GATTTCAGCTTATCTCTTATTCCCTGTCCTATAAATTAATAATGGTATGATTATTCTAAAAATATGATAGATATGTAGATAAG
TAAGAATTGATAAAAGCATAATAAATATACAATTGCAATTCGGTAAACTGAAGAACATACATACTTCTTAGACATTGCTAA
AAACAAAATCAAAAAATTGTAGATCATTTTTTTCCTATTGTTCACAAATAAGAATGGTACTATCAATGATCAATCTCATTTC
TTTCTTGAAATTATCTATAAACAAAACAATTTTCATATTGGTTCATCAAGAAACAATACTTTTTATATTTCTATATTATACTT
ACTTCTATGTTACATGTCACTATATTTGATTATCATAATTTTTTTTAAAGAATTGGTCACTTCACATATATGTATCAGATATA
TTGGTATCAGATATAGATGCATGAAGCAAATTAAAGTATCAGTACTTTGTAGCAAAACACATTCTTCAAATCATGACATGAG
GTAAAAAAAAATAAGATGATATTTTTGTAAGTATTGGAAAAAAAAAGAGTAAAGCTTCTGAAATCAAAGAGACACTAATTT
TCCACAACATCCTTCAATTGGGCCCAAGCTTCCTTTCCTATGGACAAATAACTGGTTGTTAGTGCCAGCCTTTTCTTTTTACC
AGTTTTCCATTGATGGTTAAAAGCTATTATGAACCTGTCACTCCTTAAAATTTCCACCAAAGTTTGGTAAATAAATATATAG
GAGAGTGAATAATACAAGTCTTGCATTCTATCTCTAAGTTATTAGGTATATGAAACAGGTATGGGTATTTGGTTTTAGAAGG
TATGTGGTTCATCACTATTTATATTATTACTACAAGAACCAGGTAAACTTTATTATGGTACAGTAAGTTTGGTGTGAGTTGTA
ACTACGTTATATCCATCTCACTTAGCACGATAATTAAATTTAAAAGCAAAAAGATAAGAAAAAGGCCAATCTAACAATTGT
TACCTCTCTTGCATGACAAAATCAGAAACAAAAGTCCCACTCTTTCCTCCATGGTGCCTGTAATTAACAAGCACTTCAAAAA
CCAATGTTAATTAATTAATTTCCATAAAAAAAAAAAGGCAAAAGCCAATGAAATTTAAGGGGTACAACAAAGATTTGTAGA
ACGATCATTAATATTAGTGCAACGCACCATGATGAAGTGCATGACATAATAATAATGTGGAACCAATCATGATAAGAACAG
AAAATAAATCAATGCAATTGCATGATCAGAAAATAACGAGGCGATATATCATGTTCCTATTGATCAGACAATAGGACAACG
TGTTAAAGAAATGTGTCAAGTGCAACAATGAGGGAACGGAGAAGAGAAGGATGATAAAGAATGTGGTTATGACTTCTACA
AAGTCCAATTATTTACTTTTTTAATTTTTTATATTTTCCTTTTCACTTTCCTAATAGTTGTCGGATTAAAAGGAGTTTATGGAG
TAGATTAGATTGGTTTTGAAAAAGAGAAATATCATCTGATACAATTTTTAGTTTTCTTAATTTATTGTTCAATTGATGTAGTT
TAAAAAGTTGCACTAACTGAAGTGGAAAAGGAACATAGGTTGGCATAATGGAATGGATAGCATTTGATCTTTAATAAATTT
TTGCTTTGTGATAGGTTCCTAATATTTAAAAAGTTTTGTTTGAAATACTTATCATTAGTCAAAATCCGTTATTTGCTCACACG
ATCGTTAACCAGCCACACAGACATGTCATGTGTGATTTTTGTCTGACTGAGATTAGGACTAATGATAAGAAACTATAGTCAA
AATCCTTTGGACATCAAAGAATCATTCTTCAGCAAATAACGGATTTTGACTAATGATAAGAAACTATAGTCAAAATCCCTTG
GGCATCAAAAAATCACTCTTCAGCATTCCTCTACGTTTTCACACAACCCACTATAGTTTCTTCTATACCTTTCTTATGGATTT
GTCACTATGACTTCGTCACTCGTAAAGATCCAAGGTGAAGAGGTCCTCACCAACGATTTTTAGGACCTTGCAATCAATTTTG
CATTTTCAAATCAAACCAAGCCAATTCCCAACTCAAGAAATTCACATGGATAAGGTTTCTAAGAGAACACATCAAAATAGT
TTCATGGGTAGAAGAAGGTCAACAAAACCTTACCCTAAAATGTGATTCCGCTCGGTCCATTGAATAGAGCACGAAAAAATG
AGTGGGATAGCGATGTCTGAACTTGTCGTCGACCTTTCATAGTTGCGAGCTCTTTTTGCAAACCCTTGCTTTCATGGTTGTCT
CTTCTTGTTCTCCCTTCTTAAAGGTCACCACCAACCCAGCCATCAGCCACCACTGGTGCTGCCAGTCGTGCCACTGCTCGTG
CCAGCGCCAGCTACCACCAGTAACTTCCTTCAACTCTCAAACCTCACTTCTCTCCCAGTCTCTCTCTCACACTTGGCCCTCC
AACCCACTTGTGTGTCGTAGGTGAAGAGAAGGAAATGATGAAAACAAAGAGGAGGGTTTTCTTTGGGGAAGGGGGGTCCA
TGAGTGATTTTTGAGAGAAGGAGATTTGTTGTTGCCATGGGAGCCATGGTTCAAGAGAAGAAAAAAAGAAAATGGGTTAG
AATTATTGTTGTGTTGCTGCCATGGGGTTTCAAGGGAGGTTTGGGGGGTTTTGGAGACATAATAGCGGTGGTGTGGAGCTAG
TGGAGGAGTTGGTTGAGGACTGGTGGGGGTGGTTTGGAGGATTCGGGGACTTAATGATGTCGTTTTTTTACTTTTTTCTATAA
AAAAATAAAAAATCTTACGTGATCGGTTAACGATCACATATGAAGATAATGGATTTCGACTAACGGTAGGAACTTCGGACA
AAGCTTTTTAAATATTAGGGACCCATCATAAAGCAAAAATTTATTAGGGACCAAATGTAAAAAATGAGTATTTATCAGAGA
CCAAAAATATATTTAAACCATTACCTAATTGCAACTCACTATGTGATAAGTTTGTTGACTTTTAAAATAATTATTTTAAAGTA
ATTCAAACAATAATTTATAATAGTGTAAAATCATTTTACATCATCAATACATAAGTATTAAACTCGATATCTCTCTCTATATA
```

-continued

```
TATTTTCTGTTCGAGATTGATTGAAATTATCTTATTTGCTTAACATATTAAAATGCGTCATTTTTAATGATATTATTGGTCTAT
AGTTTTTATGTAATACATTTAATAATGTTTAGAAATATTTGTATATAAATAACTTTTATCTATTATTTCACCAGAGCCTATGA
AATGTAAGCACAGGTTTGTTAATGAGTAGCACAACATGGACAGTTTGTCAAAGGCCCAATAGCATCTTTAATGGGATTCTTG
AACTCAAGAACTCTATCCACTAGATCTACTATTATTCTTATTAAGAGTTTTTTAAGATGGAGATTGGGTTCTAGGAAAAGAA
CTCCTATTTTTTCAAAAATATTATTTTTTCTTGTGCTAGTAAAATCTAATAATCCGAATTGGATTCTACTATTAGAATAAAAA
ATGATAGAAGTTCGTGCATCCTATATAACATCATGGGACTCACAAAAAATAATCCAAGAACCTAAAATGGATTCTTTGACC
AAAAATGTTCTAAGAATCTCAATATTTTCCCACTTAAGAAATATAACTATCAAATCAATATAATATGAAATGAGTTCAATCT
TTATTGATTCACTTGACGCAAGCTATATGCACAACTGACATAATAGATTTTAATTCTAAATAACATGCAATAAAAATATAAC
AAACCTGTTCCGGAAAAAGCCTCCTCAAAAAGAAGCACATTCGGTCCCCCCACAATTTTTACAAGTCGGGGTCTTTATGCT
GCATCAAAATATTCCATCATATCCCGCAAATGTTTCGTGCTATTAAGTTTATGTTAGTTGTCCCTTCATGATGCATCACCAGC
ATATCATAAACAATCAGTTAATCCCTTATTCTGCCGAAATAGTCGGATTATCGTCAATCCCCCTTAAGGTGGTCGTTTGATC
CCGCTTGGCAAGGCCCAACTTTGAAAGTGAATTGACCTAAGCCTCTTTTATGGGCTTGATGCGTGATAGAAGATCGGAACA
TAATCCAATACATTCCAATCTGAACCAAAACAAAACCTAAAACCAAACTACTAACTGATCTATAATTTTTTATACATCATAA
AACTAAAAAACAAAGCAAACTAAGCACATAATCTTACAATCCCTTCTGAATTTACTAAAAGAGACACAGATAGTTGAGGT
GGGAAATGTTGCCAAACCAGAAATGAATTATCACGCTCCAAATTAACTTTGGAAGCCAACCTGCACATACGTGTCTTCATG
AAGAGTATGCTGAAGCTGGATCCTCCAATCTTGCTCCAGCAGTGAGCTGATTAAGTTGATGAGGGTAGCATACGTGAGGAT
GAAACTTGTTGGTTAATTACTTAATTTCTTCCTAGGACGAGTCTAAGAATCAGACTCAAACTAATAGAAGCCTAGATTCAAG
GCATGACAGAGACCATAAAAGATGGCATGGAGTTCAGCCTTGAGATTGGTAGACACTCCACACGATCTTGATTTCATATTTT
TTTTCTTAAAATAACTACATACATATTAAGTAGCATGGTTTTAAATTATGATTGTGATTACTTTAAGGTGAGTCATAAAATCT
TTTTATATATTGCAGCTAATCACTGGAAAGTATGGCTGATGTGGTTACAATTAGGAGTCTTCTTAAAGCATTAATATTTTTA
ACTTAACAAATATAATTAAAGAGAAGTAACTAATAAGATAATGATCTAAAATTCTTGTATTGATTGGAAATAGCGTAAAAA
GATGTTTCAAATATAATGATACAAACTCTTTAAATGCAAATGGTTACATGCACAAAGCACGTGTATATATATGTATTCATAC
ATACATACATATATATATATATATATATATATATATATATATATATATATATATATATATATATATATATATATATATATATA
TATATACGTGTGTGTGTGTGTGTATATATAGGGAGAGAGAGTGTGTGTGTGTGTATTAGAGAGATTTTATGGTTGTA
GTTTGTAGGGGGAGAGAGGGGGAGATGGTTGGGGGGGAGAGCGTATTTTTTTTTTTTTTAATGATAGGTTTGTGGGGAG
AGAGAAGTGGAGATAGGAAGAGAAAGAGAGAGAATTTATTTGGTATGGTTAGAGGTTTTATATTTTTTTCNTCA
>BAC99.FASTA.SCREEN.CONTIG5 (SEQ ID NO:181)
CTAGGAGGATCTATTTCTTTGTTGTATAAAATCTTTGTATAACCTTAGAAATTATGAAATGTAAAGTCATAAAAAGGAATAT
TGATATACTCTATATTGTTTCTAAGTTTTTTACTATCCACTTTGTAGTAGTATTGAATAAGTAAAACTATCAAAATCTTTCA
CACAAATAAAATCAGGTGAAATCTCAATATTATGATTGGGCAAGATTTCCCTCATGAATGATAGAATCTGAATTTTATTTGA
TTCTTGCTTGCTGGTTGATTTTTTCTTAAGAATTTAACAAATATATCTTTTATATATATATATATATATATATATATATATATA
TATATATATATATATATATATATATATATATATATATATATATATATATATATATATATATATATATATATATATATATATA
TATATATATATATATATATATATATATATATATATATATATATATATATATATATATATATATATATATATATATATATATA
TATATATATATATATATATATATATATATATATATATATATATATATATATATATATATATATATATATATATATATATATA
TATATATATATATATATATATATATATATATATATATATATATATATATATATATATATATATATATATATATATATATATA
TATATATATTTGAATATATCTACGTACATTCATATATGTATGTATATGCAAACATATATACATCTGGATAGAGAGGAT
CAGAATAGCAGGACAAAGACAAACTTGTATTTGTTGCTTCCATACTAGAATTGCATTTTCTTATATCAACTGTGTGGAAGGG
AAATTTATTAACAGCGCTAAGTATTCTCCTAACCTTAAGCAGGATCTCCTTCTGGTCTCTTGCCATCTGAGCTTGCATGTCA
ATGATGAAAACCTGACAAGCGAGTCCGCAAGTGCCTCAAGTTGTTCCTGGTAACCAAGCTTTGTCACATTGACCAAAAAA
ACCAAGGTGACATTGACCAAAAAATAGTCCTGACAAGATGTTGGTAAAAAAATATAATCGGTTAATATCGATCACAAACAT
```

-continued

CATTGACTAAGGTTGACAAAAAAAATTTTAACCGACATTGATAAAAAAATAACTTCGACCAATGTCGATCAAAAGAAACAT

AACCGATTTCGGCCAACAGAAATATTTTATATGATAGCCTTTAGTTGCAAAAAGTGTGAACCAGGGGGTATTTTGACAGCC

GTAAAACATATCTCATGGCAGTGGTTGTTATATAAGGCAAAAAACCATGAACTTTCTTCTCTTGCTGGTGTTTGGAGCCACT

TCAAATGTGATTGATGTTAGAGAAGTTAACAGTGGCATTTTTTAGGACTGAAAGTTAACTTAGGAGAAACCATTTTTTATGT

ATGTAATACGGTAACACATGTACCTCTTGCACAGATTGGGGAGAAATTGCAACTTTTTTTTTACATTTTGCCTTAAAAAAAG

TGTTCATATTTATAAAAATAATTTTCTATTTAACTTGGATATTTTTTCTTATACTACTACACTAAGGTATATACAACCTAATTA

AGGCGTGTTTCTTAATTTGGAGACTGGTGCTTGATTGATTGACTACCAACGAAGGATAATCTAAAAAGGAGAAACACCATTT

ATAATCCTCATGAGTGCTTATGTCCCTTTTGCCTTGAGGTAGATGAGTCGGCATCTCACTGTTTCTTCTCATGTCATAAAATT

CTTGGTACTAATTTGGAGGCAATGTTACTCTTGGCTGCTGGCTGCATGTAAATGTGGTGTTGCCACAATGACCAGAATCACA

TTTTTGGCAAGATTCTGTATTCGTAAGTTCAAATTAAGAAGGAGGCAGATGTATGGAGGGCGGTGTGGGCATCAGAAATTTT

GGGGTGTATGGAATGCTAGGAATGAGTGTATGCTAAGGAATTAATGGCTCTTTCAATGCTGAGAAAATTACGCAGAATATA

TTATTCTTTGCACGATCGTGGATTAATAAAAGCCAGAGTCCCTAATTTTAATTATTGTTTTACTTAATGATATATGGCACCTG

GAGCTTGTTTCATGAAGAGACAATTTTGAATGAAATGTGAAGTTAATTTGATTCGGTGGTAGCTGCTCTTCGAGTGGGATCA

TCCCAAATGCAACCGATGTTTATGTGCACGATGGTGGGGGCTGGTTAGTGATGCGCATCAATGTTGCATGGCTTTAGACATG

ATTTTAAATTGCAATTATGATTGCGTTGCTTGCAACGAACCTAAAAATCTTACATTGTGGATAATTATGGAAAAATACAAAC

TGATGTGATCATAATTATAATTGTGATGTGATTACAGAGTCAAAATACATTAGCGTTATGACTGCAATTATGGTTGCTGACT

ACAATTTAAAACCATGACTTTGGGTGTAATGGTCCATGTTCGATGCTAGCTATCTTTGTCGAGATAGAAATATAATCTAACC

ATGGAATTTGCTTTCTTTCTACTGTCACTGGTGTATATGTTTTTGGATCTTAGGTACTTTTGGTACCATTTAATACAAATCATT

TTGTTGGAAAAAAAACTACGGTAGCCTACATGCAATATACAAAATAAAATTGAATTACTATATATTATCATAAATAGTAGA

GTATAAGAAGTAAAGAAAATTCTAAAGATAAACATGAATTTAAAAACATATGAAACTAATATATATATATATATATATATA

TATATATAATAATAATAATAATAAGAGATTGTTTTAACTATATATATAACATATTTAATTAGCTTAATAGAAATGCGAAAGT

ACAATAAAAAGCAAAAACATAATAGGCGTGACAAATCGGTTGCTAATATACAATAAAGACAACAAAGTTTGAAACTAAA

ACCTTATCCAGACTATCCAAATAACCCTAATTAATCATGCAAAAATTAGAACAGAAGAAATTTAATAACTATAGCAACAGT

AACAGCAGCAGCTATAGCTAATGCCGCGATCACCGAATCGGAAAACTTTTCATCATTGAAGTATTCTATTTCACTAACCCTA

AGCAAGATCTCAAGTTGATCGCGTGCAATAAGAGCTAGCATTTCAATATTGAAAAACCTCTCAATTGAGTCTGCAAGATCTT

TAATTTTAGTTATCCACGGTAAGAATTATTAGCCACAAAATTGTATTTCCCTATTTTTGAACACTTGTAAACAACCTCTTTGC

TCTTCCTCAATAGTTGTATCAGTGGCTCAAGTTCCTGCTGTGAACGGCCCAACATATTCCTGTACTTACCTATCTCCTGCCAT

GTTTACCGCTACATATTTTCTAGAATGTTATTTGAATTTCATTAAAAATCATAAGAAGCAAGTTTGAATTTTTCAGTGAAATT

TTTACTTAGGTTTAGTTAGAAAACCCTATTTAAAAGCTATATTGTTTTGCTTATCGAAACAAAACCAATTAGTTCGGTTTGAA

TTTCTTAGTTAATAAATCAATTTTATATGATTTTTTATACAAAATATTAAACTCAATTTACTAAATAAGATTTATATCAAATT

CATGAAGGTAAAAGTAATATTTTTATCTTTTAATGTAAGGCTTGGTTTCACTTTTGTCCTTTAACTTTTTTTTATTTGATTTAT

TTCAGTTATCATTTAATATTTATGGGTTCTTCCTTAAGGAATCTTGATTTTCCTATAGTTTTAATTGTTCTTCGGTTATTTATTC

CGAAATTGAGAGGGGATCATCACCTCCAAAGATTTCCTCGCTCCCATTAACAAAAATGTCTAAACAATTACCTTCCTTCTAA

AAAATTTGTAAAGTACCTCCACTAATTAAACTCAACATATTCTCCCATACTTCATTTTCTTTGAAAACAATGTTGTCTAATTC

AAGACGCTTCGATATAAAATATTTAGTCGCTAGAACGAGAGAAAAAAATTGAATAAAAAGAAGGGATTTTTTTTTCTTCT

TAACGTACTTCATGCTACTTATTTGCTGGCAATCATTATTAATATATATTATCTTATATGAGACAATTTTGAACATTTAAATG

TTAATTTTGTAAGTATCTTGGTAGTATCCTTTTCTGATAAGGAATAGATATTATTTTGAGATTATATTATGATGATGAATTGT

CTCATAAAAACACGAGGCAAGCACTTGAAAGGAACAAATTCTCTAATTTCTTAGTGGGTAGTGGGAGAGAGGAAGTAAACT

TGCTTCAATAGGCAAATGACGCATGACGCACTCTTTATAGGAGAAGCAACACTTTCTAAGGTGCTTACCATAAAAAGCATT

TTGAGAGGCTTTGAACTTGTCTCGGGCCTCAAAATGAATTTCCATCAAAGCTTTTGTGGTGCCTTGGGAGTGGATATTGATA

-continued

```
CCTTGATGAATTATGCAAGCTTGCTTATTTACTTGAGACAGACTATATATGCACAACTGACAAAATAGACTTTAATTCTAAA
TAGCAATAAAAAGATATATAATAAACCTGTTTGAAAACGGAGGCTACTTCAATCTAGTACGGTAGTTGACTTACTAAGTAC
GAAACAACAAATTAATGAGACTGCTGACTACTGATTTCATAGAAAGATTTAGGAAGATGAGGAGTAAGAAATGTATGGTAA
AGCTTCTAGGAGTAGAATATGTTACTATGTCTTAAAGTAAAAAAATATTTATGTTTAAAAGATGAATTATGATTCATAATTA
TTTTAATTAAATATAAATAATAAAAGTTATATATAATATATTATTGGATCATAATTTATAATTTTATGTTTGTATTTTCAGTCA
ATACATTTATAAAACAATTTAGCATAACATTTATGAACTAAATTTAAAACCTTTATTTAATATTTTAAGATTCTTTCATTAGA
AACAAGTTCCGGTATAGGAGTTGGTATCCTTTCAAATGATATAAAGCAATAGATTTAAATTTTATATTCTATTTTATTGTGTC
AAAATAATGTATTAAATTCTTTGGTAAGAGACACTATAATTTTAAGTTATTAAGTTGATAATTAATTAAACATGATTTTAAAT
ACTTACATATTTATTCACTTATAACTATAAAGATTTAGTAAGAGCATAAATAAAAAATGTTGTTATAATATATAATTTTAAAT
TTAATATAATAAAAATGTGTTAGCAAAATAGAAATATAAACATAAAGCGTGACAACACATGTTTTTAGTTAATAATAATAAT
AATATTAATTACAAATATTAAATAGGTTTTGACAAAATCATACCTGGCGCAAATATGCAGTTTAGTGACGGAATTAATTTGT
GATTCATGCAATACAATTTGTACCAATCATCATCATCATCATAATCTCTTTTTCGTTTTATTTATCAATGTTGCTACTTAGTAC
GAAAATTATTTGCACAAAATACAAACAGAATGATGCTATCTGTTATGAAAAGTAAATCCACACAGAATTACACGAAACATA
GAATGGACGGTTATGATTTTATAAAATGAATATCGATTAAATTTAAATGTTATGGTAATTTTAAAATATGAATGATAAAATG
ATTCAATTATTATACTTTAGTTTGTAAATAAAAATTGATTTTTATAATATTTAAAGTTTATAAATAATATTTTGAATAATTTTA
AAAATAAATTAATTAAATTAAATGCAAAAAACTGAAATTAAATATTGCTTAAAACTAATTAATTATTATTATATCATCTGCT
CCATTATAATTGTTGTGTAAAAAATAATAATTCTAAAATAATTTTTATTTTTATTTTTTAATGTAAAATTAATTATGTTTTTT
ACTTATATTTCTTATATATGAATGATGAACTACAAAATTTAAAAATAAATTATTGATGATATAAAGTTAATTTTATAAAATTA
TTTTTTATTTTTTTATTTATATAAAATAATGTATGATGATAATTATTTTCAGAAGAAAAGCAACACTTTTCTAAGATAAATTG
TTATAGATGTTTAATATTATATTTTGCTTGTAAGACAAAAACATACTAACTACTAAATTATCTAATTTATGTATATTTTTAGT
CCTTTGCATAATCGGGCGATAACTTATCATATGAAAGAATACTGATGATGATAAATACTTTTTGAAGAATAATAATTTTTAT
GAAATATTTGAATTAGTTTTACATTAAGAGTTTCTAATGATCTTAAAATGATTAAATGTATTATATTATATTTAGTAATATAC
TTAAAAATTTAAATATTGTTGTAATTTTAAAATATGAAAGGATAAAATAATTGAATTATTTTACAATGGTATTTCAAACAAA
AATAAATAGTTATACTTTTTTTTTATAATACTAGTATATGTATAAAATAGAAGAAGATAGATAAATAATACAAGTTATATCC
AATTACTACAAGTACGCACCGATCAATTTCAATAAAAAAAAAAAAACAAGGTGTGAGTGAAGTCAACAATTAAGATAGAAA
TGAAGTTGGAAGAATCATCGATTTTAAGATTGCATTATATGCTAATAATTGGGCTGACTATATATACCCAACAATTAATGTT
GTTATCGTTGTTGTGCTTGTCTAGTGAATGATGGCAGATGTTGTATTTCAAGGTATGGGAACTGCGTGGCAATTTCTGAACG
TGATTATGGTCATAAAAGACAAAGTTACGTTCAAAACAGCATTGGAAAACCTCCAATCCATTCTAATACGCAGCTTGTTTCT
GATTGTTCCAAAGTCCACAGCTTAAATTTTGTGGCCAGGCATCGTTACAATGTTAAACTAAAGGCATTTACAAAGTCATTTC
GGAATATTTACTCCACGGTCATGTTAGCTCAGATTGCAAGAGATCAAAAAGAGAACCGTAGGAGTCAAATACTACTTGCCT
ACAATAATCCTGCTCAGTCTCATAAGATTCTAAGTATTGTTGATATATATTAATATTAAGGGTCTATCTGGATAAATGTATTT
AGAAGTACTACTAAAAAAATCCATCTCAAAGCAGAAAACGCCCTTATTAGCTTCACAGCAAAGACAGAAATCCACGTCAA
AAACATTAACAACGTGTTTTCAATTGCCTCCCCAGGGTCGAAGCACGTTTTCTCAACAACCCTAAGCAATGTCTCCTCTGAT
CTCTTGCCATCTGAGCTTGCATGTCGATGGCAAATAGTTTCCCGAGCTCGTCGAAAAACCGGTCCAGTTTGTCCTTGTAACA
AGCCCTAGTCACAAAGTGTAGCCACCGGATTTTTGAACACTCGAAAACAAGCTGTGTCCCCTCCTCCATCTTTCTGATAAAC
GATTGGAGTTCCTCCTTCGGAAGCTGCAACTCGTTGTTTTCTGTTCTATCTCCTTGATCACCGGAGATATAGCTACTAGAGT
GGATATTGGAGGTGCACCAAAGATGATTTGAAGCAAACCGTTTTGTTTTTAAGTTCCAAAACGGTTCCCAGCAACTCGTTGA
ACACAGCTCCCACTGTTGCTTCTATTAGTAGTGCCATGATATTCACAACAGAAACACGCACCCACAAGGATGAAAACAAGA
TGAAGAAATAAACCTCTCTTTATAATATATAGAGTCAGGTTAAACGTAATGTTAAAAAGGAAGTTTCTTGGAACTCCATTTC
TATCCTGTTGACTTTACGAACTTGTAGCTAGGTATACTTGTTTGTATTATTTACCGACTTGAACATATTTTAATTATTTATTTA
```

-continued

```
ATTAACTGAATAGTTATAATTTCCTTAATAGATGCGAGATGCCAAATCTTGTTCCACCCTCCAACCCCAAGGATAATTAATA
GTTAAGTGTGAAATAGTATGTGTGTGTCTATCTATATATATATTATAAAATTTTTATACAATTATCTAATTATAACATATTA
TTTATGTGAGAAATTTATTAATTTTTTAAATAATTCAAATGATAATTTATAATCAGATGACCGTGTCAAATTATTTTATACCA
TCAATGAATAAACATTAATCTCTCTCTCTCTCTCTCTCTATATATATATATAAATTCTAATCAAGGTTGGTTGAAATTA
TCTTACACTAAAACTACCATTATTCTTATTCAAGAGTATTTCATGATGAAGGTTGGATTTTAGGAGAAAAATTCCTAAAAAT
TCCTTTTTTTTTTGTGCAAGTAAAATCTAAGAATTCAAATTGAATTTTATCATTGGAGCAAAAAATGATAGAAGTTGTTGCA
TTCTATATAGCATCATATGACCCATAAAAAATAATCCAAGAATCCAAAAAGGATTCTTTAACCAAAGATGCTCTAAGAATC
TCAATATTTTCTCACTTAAGAAACATAACTATCAAATTAATATACTATGAAACGAGTTTAATCTTTAGTGATTTACTTGAGAC
AAACTATATGCACTACTGGCATAATAGACTTTAATTCTAAAGAACAATACAAAGACAACAAACATGTTCCGGAAAAAGCT
TCCTCAAAATGGAGGCTACTTCAATTTAGAACACTCACGTGAAGTGTATTGTATAACATGTCTCCTTAGGTCAGAATGAGAG
CTTTTTATTCGTGCTTGAAGCACGCCCCCTTCAATTTTTACAAGTCGAGGTCTTTATGTTGTATCAAAATGTTCAATCATATC
CAGCTAATGTTGTCGTGCAATTAACTTTATGATAGTTGTCCCTTCATGATGACTAACTGTCGTACCATAAACAATTCATTAAT
CCCTTACTTTTGCTAGCGAGAAAATTGTTGCTGCAGTCCACTGTAATATCATTTGTTGCAAAAAATTTTGCAACGATATTTAA
TGTCACTACCACTCTTAACGCTTTCGCAACAAAAACTTCTACTATTTGATAACTACGAAAATTAGGCTTAATTGATAGTCAA
ATTTAACTAAAAATGATTAGAATTTCTTTATTTTATTATTATTTTTAATAGAATAATGAGGATTTTAATATCATTTTAATTCTT
CTTTCAAGTTTTTAATTTCTCCTCCTCAGTAATCTAGATTCCATAAGATACTTCTTGAAGTGCAGCTATGATTTTTTTTTTTT
GTATTTTACCATTCTTTTCTTAAAATTATCATACATAATTATATATGCTATATACTTGTTGTTAGGGAAGAAGATAAAAGTTG
GTTTTCGAGGATCAGGGCCTCCACTGAGAAAAGGATAAGGGAAGGAACAGTTGTATATTCCATTGATTGATGCTGTTATTAC
ATAATATTATTTATACTGATTTCTCAATAATCAAATTTGTCTTTTTGTGCTACAGAATATCAGCAAATGGTTAAGTTTGTCTA
CCCCTACAGTACAGTGGCGGATTCAAGATCCTAAGTCAGTTGGTACAAATTATAAAAAATAAAATCAGTGGGTTCAATTAT
ATAAATATAGATGAAATAAAATATAAAAATATAAGATTTTATTTACAAATTTGGTGAATTTTAAAAAATGAGGGGATGCAA
GTGCACACCCTCAGATGGCTGTAGGTCCGTCATTGCTTCCAGATATGGTGCACCTGCTTGCAATCCTTGAGCTAAGTGGGCC
TTGTAATTGCTCTCTTGGTCTTGTTTTCTAATTGCACCCTTTTCTGTTGCTTGCTTGCTGCATTCTCATCCTCTGTTTCTGCAA
CTGGTTCCTTTGCTACGCTATCACTTGTGGTGCCGTTTTTGGCTTTTCCAGTCTTCCCAAGTTCCCACTGATTCAAATTCCAA
AAGTTCTGCAAATAAAATTGAAGAAGAAGCTAGAGGTGGGAAATACTTAAGTCATTCTCTTGAAAAAGTTGCAGCAATGAT
ATGCAACAAAATATCACTATACCGAGTCAAGGTAATTATTGTGTTCACATGAACATTTCTCCCATGAAAATATATATTTTCT
GACTTTGTAATCTCTTTATAGTATGCATGGAAAAATAATTTTCTGATTTTTTTCTCTGTAGTGTTATATATTATTTTTAATCA
CATTTTCTTATTTATTTAGTTTGTTTCTGATTTGACATCATGTGAATTTGGAGATTTGGGTTAGAAATATTTTTGGAATTTTCC
TGGTTAGAACTTGATAGGTCCATAATGAAGGTATATAAAAGGATAGGGAAAAGAGGGAGAGCGGAATAGAAAAGAAAGG
ACAAATGGGCCTCAAAAACAAGACATGCTTGTGTATGACAGCAGAAAGAATCAGCAGTACAAGTTGCACTAGCTGAAGTG
GAAAAGGAACATAGGTTGACATAATGGAATGGATAGCTTGTAAGGAGAGTGTACGTAGAGGCTGAGAATAAGTTCTTCCTT
AAGAAAGGGAGTGGGTCTGGGTTTGTTTTTTCCTAATTACCATTCTCAACATCTGGCTTGTATCCGCCACTCCCCTTCTCTCT
GAGTTCTATTTTTCATACTTGGAAGCCTATTTTTTTAATATAAATATAAAATTATGGGATATCTACCTGTCAAAACTTAAT
ATAATATATTAGTATCTATTATTTATTTATTTTATTGATTTATTTAGTAAAAATCACCCACTTTTCTTTCCGCATACATCTTT
GACATATATGTAAGGACATTGAAATCTTTAATTCATTAATATATGTTTTTAGGAATAAATTAACATGTGTTCTTTCTTTAATT
CTATGCGTATGGGTTAACCAATATTCAAACTCTAGACCATTTAGTTAAAAAATACAAGTCATTACTATTTGTGTCAATCATT
ATTGGTACACTGCACAAGTTTAAAATCTAGTTAGATTTGTAAAGAAATGTTATGTTACATTTCAAATGACTTCTGACTTTCTT
TAGTAGCTAAAAAACTTGTTTAACTATTTGATAAACAAGTTTTTTCAATAATTTTTAACATTTTTTAAAACGTTACTTAAATT
AATATTTTTAAAAATACTAGTTTCTAACATTTTATATTTTTTTCTTATTTTATCTTTAATATATAAACTTAAATCTTGAATTAG
TTAGATACAAGACTATATCCAATCCCACTTAACTAACCTCAAGAAATTAGATGTCTTATATAATTATTAAATTTATTTAATA
```

-continued

```
CACGTCTTTCATTTTGTAATGATAAAAGATTTACTGATAATAATGCATTCCTTTTATAGTATTAATTATTTTATTTCTATTATG
ACATTATTTTCTTACTCTAATTTTTAAATATTTTTACTTCATAATAAATATAAGAAATGTAATATCAAATATTATATTAAAATT
AAAATAATTTTAATACGAATAAAACAATTAATCATATTTCTAATTTATGCGTTATGTTTTTAAGCTGAAAAATAAAATTAAC
TGTAAAGATTTGGGTTTAGTTAAATTTATTCGTAATTGACTTTAGAAGGAGTAAATTGAAATACACTTTTAAATTAATATTTG
AGTTTCTCTATCAAAAAAGGCTATTTGAGTTTTATATTTTTATTCCGACGTCAAATTCTTTGATATGTATAGACTATATTTGA
GATACTTTTCGCTTTGAATTTCTATCACGCTCTGAGAAATCAAATATATATATATTTCTCTTGATCTTAACTTTAAAGTTTAA
AGTGATATGAGATTTTTACACATACTAAAACAATTTTTTCTCAAATAATGCATCCATTGATATCCTTGTCTTTGGGTTTGGAT
CCAAGAGTTTCGACAGCAATCTGCGTACATCTGGTGCAATCCAGTTAGGAAATTTGAACTCTCCCCTGCCAATAGAACATA
CAAGATCATAACTCCTTCTGTTTATCACTTCCGGAGCAGCATAGGCAGGGGCACCACATGTAGTGTGGAGTAATCCATTTAT
ATTCCCATTTTCATCCAGTAGAAGATTTTCTGGTTTCAGATCACGATGGCACACACCTCGGCTATGGCAGTAGTCAACAGCG
CTGATCAATTGCTGAAATTATCTCCTAGCATCATCCTGCTTGAGCTTTCCTTTGGATACCTTATTGAAGAGCTCACCACCTTT
TACATACTCCATAACAAAGTAAATTTTGGTTTTGCTGGCCATTACCTCGTAAAGCTCAACCACATGTGGATGCCTGGTTAGC
CTCATCGCTGAAATTTCGCGCTTAATCTGATCAATCATCCCAACTTTCAGAATCTTCTCCTTGTCAGTAATCTTAATGGCCAC
ACTCATGCCAGTTATGATGTTCCTAGCATGGTAGACTTTTGCAAAGGTTGAACAAGGATAGCTCAGATGGAGGCACGGACT
CATCAACCTCGGTGAAGGAATTCTTAACTGTCAAGCACATCTTTCACCATTCCCTGATTTTGGTGATGACACTAGAGAACAA
TGAAGAATATGGACTTCTTGGAAAGTTTGAAGAATAATTAAGGAATGATGCAGCACCTGGTTAGCCTTCCAATTACCCAGC
AGCAGAATATACAATGAAAGACACACCTGAAAGAAAGATGAACAAATTTAATAAGTTGGGATCATTGTCAGAGAATATAA
TCTCCTGAATAAAATTCTTGAAACTTCTACAAACATAACCAGCATAACAATTTTTATAACTTGTTTCTGATGTCATTTTTGAA
CAATCCCAAAACCATAAGGCATTAGGTGAGTTTTGATCATATTTAAACAGGACTGGATTAAAAAACAAAGTATTTAGCACA
TCAATTACATTTCTCTCAGGTAGTCTAGTCGTTTTTAGAGTTCTTATAAATAAACGATTCATGACCAAGAAGAACAACACAA
GACTAAACAAGTATGACAGAAATGTAAGATTGTCAAAAATCAAGAATAAATCGAAACCAGAGATGGCCACACATTATGCA
GAAGAAATAAAATTTAATCAAACAATCAATCAGCAGATGGCAGAAAGCACACTAATACAACAAAATACATCAATAATGAA
CTTGAGATTCATAAAAAAGGAGCATGCAAACAAGTGAGACCTGCATTCTGTTTTGAATTACATAGACAAATCAAGTCATTC
ACACTCATCTGCCCAAATTAATCGTCTAAAGTTGGGAGAGTTTAATGACACTCGAGAAGAAAATGAAAATTCAGTAAGGTT
TCAAATAAGCAAGTATAAATATAACTGAGTTGCCACCGTTTTCAGATGAATGTGGTTCCACTTTCCATTACAATCGTTACCG
TTTGGCAGTCTATCTACCAATTTTCATGCTTGGGTCACATGCACTAAGTTATTGTCAATACATATTGGCAACAAATTAAAATT
TTCCAGATGAAAAAAAAAGGAAAAAATTTACAAATTTGCCGATAAGAGAAAAAGGCAAATAAACACAAACACCCCTCTCA
CCAAGAGAGAGCTTAACTCATGAAAATAACAACCATCCACCTATACCAGAATTTGGTTTTAAAATATCATAATTTTGTACTG
TTTATTTTTAAACATGTTATTATTTGTAAAAATTGACCAAAGGTGCACTTAGATCTTCTCATGCTACACAAAAATCAAGTTTA
ATAAACATTAAGAAATATTTGTTACATTTAATAAGGGAGATTTTCATAATAAAAAAAATTCTGAATTTCAATAAAAATACAT
TTGATGATCTATTTTTTGTAGTATAAAATCTTTGTATAACATTAGAAATTATGAAATGTAAAGTCATAAAAAGGAATATTGAT
ATACTCTATATTGTTTCTAAGTTTTTTACTATCCACTTTGTAGTAGTATTGAATAAGTAAAATTCTATCAAAATCTTTCACAC
AAATAAAATCAGGTGAAATCTCAATATTATGATTGGGCAAGATTTCCCTCATGAATGATAGAATCTGAATTTTATTTGATTC
TTGCTTGCTGGTTGATTTTTTCTTAAGAATTTAACAAATATATCTTTTATATATATATATATATATATATATATATATATATAT
ATATATATATATATATAGATTTTAATGCATTAATATACTTAGATTAGATACATTAAATTTCAAATTTCTGTAACAACCTTT
GTGAATTATAAGGAAAGTCTGGTCAACTAAATAAGCTAATTTACACTCATGCATACAATCGCTTCACTTGAACTTAACTCAA
TCGTCATCATCATTATTATAGTGAGTTAATAGAAATGCAAGATTCTCATTACTAAAAAAAAATAGTCATTACTAAAAAAAAT
AGTCATTCCATAAAAAAATAGCTATAAGAGGTCTTGTTAATAAATATTCTTAAATACTAAGAAAACTTAAAAATATTAAATA
AAAATATAATATTAGTATATTAAAATTGTTTGAAATTTAATTTATTATTCAAACAATTTGCTTTTTTAAAAATCTTAACAATT
TCACTTGTTACAATGTGACAAAACATTCAAGGAAGAAAAAACAAAGTTAACTTATATGTGGGAGTGAGAAATAGGACAACA
```

-continued

```
AATGAGGCTATAAAAGTAATATATTGTTGATAAATAGAAAAAATAAGTTATATAATAAAATTGTAAAACAAATTTAAAACT
TCATTCAATAATATTTTATCATCTATAATAATTATGATAATTATCTTAAAAATCATATTAATGATGATATATGAGTGAATGAT
AATATAAAATTAATTTATACTTAATGCATGAGTTTAAATTATAGAAATATTCTTAAATATTAAATAAAAATATAATAATAGT
ATATTAAAATTGTTAAAAATACTGTATAGTTTATCGTTCAAACTTTTGGTCCTTTATTAAATCTTAGTAACAGCTCCCTTGTT
ACAAAGTGACAAAATCTTTTGGGTATGAGATTGGTGAGAATTAGGGACAATGAAAATGATGGCATGCCAAACATCGCTAAA
TTGACCTAATGGGGTTAGTTTTACAAACTAATTCCCAGAATAGGTCTGTTTTAAAACTATTTTCAAGGGGTTTCTTTTTTAC
GTAGATTCAGCCATGCATGCATGTATATCGCCAGCATGCATGTATATCGTCAGCATGCATGGCGAAATACGCCTGCACTGG
ACATGTGGCTATTCCGCCAGTGTCACTGGCGAGATAGCTGGCACAGTTTTTGCCACTTTGACTGGAGATTTCGGTGCAGAGG
GCGCAGGCAAGGTGCAAAGGGCACAGGATAACAGTAGGGCAGTAGGGTTCAGGCTAAGTTGGTTTTGCAATCAGTGTTGGC
GAAACAAGGAGCATATATCGCCAATGGTATTGACAAAATAGGTGTGTTGTGCCCTTTAAGTAGCAACTTCATGTTGATGCTT
TCGTGCTGATGCTTTGTGCCTTTAAAAATTTCTGAGTGTTCTAAGTGTTTTTAAAGTTTCTCTCAATCAGTAATTTCTCTTCTC
TGGCATCGTTTTTATTTATTTGAAGTAATTATTTTGAGTCTGGAATAAAATTTGAGTTTCGACTGGCATCATTTTTATTTATTA
ATTTCTTTGGCATTTTTTTATTTATTTAAAGTAATTATTTTGAGTTTGGAATAAAATTTGAGTTTCGAGTATTTTTTGTAATTA
GATTTGTTTATTTTGAAGTTATTAATGTTAAGATTAATTATTATAATAACAACTTCTTTAATGATTTGTTCTGCCTTTAAAAT
GTCTACTTTCAAAGGTTTCCGTTCTGCCTTTAAAATTTTTACTTTCAAAGCGTTCAAGTTTTTTAAGTTTCTGCATCATATAAT
TAATTTTTTGTTAGAATAAATTTTTAATCTAAAGTTTGAGTGTAGTATTTTTTAATTATATTTACTTATTTTGAAGTTATTAGT
TTTAAGATTAATTATTTATAATAGCAACTTAGTTGATGGTTTGATGTGCCTTTAAAATTTCTACTTTGAAAGCGTACAAGTTT
TTTAAGTTTTTGGCATGATATTTATTTGAAGTAATTAATTTTTTATTAGAATAAAGTTTTAATTTGAAGTTTTAGTAACAAGGT
TTTTTGTTATTAGAATACCCAAAATAATTTAAAATAACAAACAAAAATTTAAACAATATATATTCCAAATTCATACAAACT
AACATACCATATATTTGAATAATAACTTAAAATACCTAAAATAAATATAACATCCAAACTTTATAATACCTAAAACTAAAA
CAAATAATTTAATTATGACCAACAGAAAAAATAAAACACAAAATTTTTTAACTACATTCCAAGTTTGAAAAAACCAAATAT
GGGCGGGAGAACATGCAGCTCACAAGCTTTTTGTCACCACCAAAGCGTAACGTAACAACACCAAACCACTACTAAAAATA
AAGGCCTTGTACATCGGTTATAACGACCTTTCTACATCGGTTATGACGCGTGGTGGTAACCCGGGGTCGTTGAATCACAACA
TCGGTTTTATGACCGTCTTTGAAGGCCGGCTTTTCTACATCGGTTGTCTAGCTACAACCGATGTAGAATGGGTAACTTTCTGC
AGCGGTTCTCAGGCTGAAACGATGTTGAAAGGGTAGATTTCTACATCGGTTATCAGTCAACCGATGTAGAAAATGAAAGGT
TTCTACATCAGTTATAGTTCAACCGATGTAGAATGACTAGATATGGTAACGTTGCTACATCGGTTATCAATCAATCGATGTA
GAAAATGAAAGCTTTTTACATCGTTTATCGTAAAACCGATGTAGTATGGGGAGATTTTCAACATTACCTTGTATTGGAGGTA
TATTGATCCTTTCCTTTAGCAATAAAAAATCGAACACGATGTCCCAACTATACTTAATTATTCAATTCAAGAACCTGTGATT
ACAACAAAAAATTGATTTTCAGGTTCAAGTCATAACAACTGAGTATAACTAAGAGTTTTCTAGAACTTATTAGTATGGTACT
GTATGACATGGATGACAGGATGCGATTTCTCATCACAGTATAAACTAAAAATTCTTATGCATGTGTAGAGGCTACCACTTAA
TGTTTTCTCATATGGCTACTACAAGTCACAATTTTCTTGTGCAATGACTAAAATTTAAAATAGGAACTATAAGGCACAAGA
AATAGTTTAACCAACGAATTTCTTGTAAACATAGACAAAAGTCAGAATGGAAGGACCTCAAAATGACCTGGCAATAGCAAT
TACTAATTTGATAACTTATAATATCATACATTGGGTACAAAATGAAAAAATAAAATGTTATAAACATATAATATAAAGAAA
ATGATAACTTAATCATGTAATCATTTTGTTTTCTTCTAAATTTCAAGAAAAATATTGTAAGTAGTATTCCAAGTGGAAGCAAT
ACCAATCAAGCACTGGACAATTTGAATCTCTGTCAAGAAAAAATGCTACTGTCTTATGGTATTTCAAGTAGAGATGACTTCT
AGCGTGTCACAGGAAATAAAAACCATCTATTACGAAAGATAGATGTAGAAAATTAAAATGAAAATAGTACTGTATGCATCA
ATCACAGGAAATAAAAAACAGGCAAGACCCTCGATATTGTTCATCTAACACGTGCAAAATATATTATTATACTGTATGAAG
TATTTTGATCTGGTAGTATAATTAGGGTCAGTGCTTGAGCAGTTCAGAACAGAGCGCTGCAGTGTGCAATAACCAAGACAACA
AGGACTGACTTTTTTTGGTTGCACAATAAGTACTGTCTGACACTATGATTGCCACAATAAATAGTTTAAGAGCAAATTAGTA
ATAAATGTCAGTTTGATTTAAACAATAGTATTACACTCCTGGGCTCAGTGGGCTTCATGCATCGAGCCAAGTCCAGCGAAC
```

-continued

```
GTGTAACACGCTCCAAATTTTATTTAATAAATTTGTTACTATTTAATTTTTAAGTATTATTTTGTGCAAGTTGAAGCTTCCTCA
GTTCCATAGCACTACTATAGCAGCAATGCTTAACTAGACACTCAGAAGTTAAAATAGAAACCTGAACTATTAAGTAATAAA
AACCAGTTAACTGTTATAAACACCTTCAGAGTATATCAGTATATTCCATATACCTAGGCTTATTTTTTGGAGGCAAGAAGT
TTCTGGTACTCTGCTGCCTCTGATTTTGCTTTGGCAATTCTCTTCTTATCTGCAATCCTTGCCCTCTTTCTTTGGAGGGTCAGG
GGAGTGACCAGCCGTTGTATCTTAGGACCTTTGCTCACCTTTTTCCCTACAACCAAACATATGCAACTCAGACTAGAAATCA
TCACAATCATGTCCAAAAATAATCTCCTTCAATGGGTCCTACCCATCAAACAACAGCATAAATATGCAAAACAAAGTTTTC
AAATTTGAACGAGAAGTGATAGATCATAGGAGATAACCTCTTACGATACATGTACTAATTTTTTAAGATTATCAAAAAGAAT
GACCTGAAGAAAACACATTTTTATCAGAAGTCCTATTTTTGCTACACACACAACTCTGAATGGATAATTTAGATAAATTCTT
ACTGCAAACAAAATATATATACAGGACCACAGATAAATTTCAAAAGAAATTTTCAAAAACCAGATAAGCTCTGTTAATGTG
GTCACCTTAAAAAAAACAATCCATTATTAAAAAAAAAAAACTTACATAACATCACGTAAATTTATATATTTCATAGAATGAT
ATAATTTTTTTGTCTCTATCAATTATATGAAGCTCTATAAGCTTGTTCAATGGTAATAGAGGCAATTAGAAGGTAAGACAT
GCATGTGTACTTTGTGAGAAGTTAACCAACTAATTCATTTGTTGTGACTTTGTTAAAAAAAATAAAAATTGTGAAGAACGGC
TTCTCTGCCAACACAACCAACTTTAGTCAATTAGGGTGTGTTGTTTGGAGAAAAAGAGGATAAAAGAAAGTAGAAATCAAC
AAAGTGAGATTCACATTTCTACACTTTAGTTTTAAATTTTTATCTCACTTTAATTTTTTTTTCATTTCTTTCCACTAACAGAC
CCTTAAAAAATTGAAAAAATAATGTGGACAATTTAGTCAACTCACTAACACTATTATAAGCAAGTGGGTTTTAAATTTTGAA
AAGCATTACGCAATAAAAAAATTAAATGTTAAACTACAAATCATGAACAAAATCATATATGGGATTTACTAGATGAGAAA
ATCCATTGTTTAATTTCCTTGAAAAGGAATTATTACTCGGGTTTTTTTTCTAAGCAATTAAGCAAAGAGATATCATTAATAA
AAAAGCTAGAAGACTGTACAAGATTTACCTAGGCCAAGTCATAAGACAACATACAAAGTTTAGAAGCAAATACATCAGAA
CATAAAAAATGCAGTAAAAACCAGGATCATCCTTTACCAGTAAAAACCAGGTTCTCATCCAAACTTGGCCTTGTTCCTCTCT
TTCTCTTTTCGTGTACCCGTTGCTAACCACGAAGCTTGATGACCATGACATGACCAAAAATAAAATATATCAGAAAATGATA
AGGTCGAATAATACGTTAAAGGGCAAGGTAGATCAGCAGTCGTAAAAAGTACTTTTTTAGTAGTGGAAGTCTATAGTTGT
ATACCTCTCAGAGCAAAACTACTTTCTATTACCATCAAGCGCTTGTTTCTTTACAAATTACATAACTAAACTTGCCCCTCTTT
ATATTCATTAGTATTTTCAAATTTCATCCTTTCATCTTTTGACTTTTAATGCTTCTTTTTCCTGTTATTAACATTGCTTGTTACA
TGTTTTTTAGTTAAGGGTAGTGGATTGATTAATAAGTTAAATAGTTGAATAGTTACTAAAAAGTTGTATAGATACTAAACTT
GTATAGATAGAACATGTATCTTTGGGCTTATTTTAACTAATTACATTTAGTTGATTTTTTTCTTCTCATTTATTATTGTCTTTT
TTGGCTTAATCGTGTTTGTTAACAGTTGTGGTGTGAAGTATTAATGAGGATGGGATTTGAAGCTTCTTTACACGGTTTGGTTT
TGTATTTTGCAGACAAATTCATTACCAAGGCAAGGACCAAACACAGGTCTTGCACTCCAGCTACCAAACAATGCACCTGCC
TGGCAAGGTCCTAACACAGGACTTGCAATTCAGCCCTCAATCTGGTGTACAAAAACTTGTAATACATTTTTGTTTCCAGGGC
GTATTTCAATCTGTTTGTAAGATTTTTAAGATACTCATATCTGTCATACACAAATTCTCGTGTAGTTGTTTGAGTATATAATG
AAAGTGTTAAAAAGTTTCATCTATTACATATTTGTATTAATGGAGGGAAGAAGAGAATTAGGTTTTATGTATAGGATAGGAT
AGGATAGAAGTATATGTAGAAGTTCTTTTTGGTTTTACTATATCAAATTAGATGTTTTTTGTGAATTGTGATGAATGTTGTCA
TGACTTAAGGCTTAAGCACAGCAGGATTGGTCAATAACAGTAGTTCATTATGTGGAAAAACCCCGAGGCTTAATTACCACA
TTAACATCTTATTTTGCTCAATGTAAGATTCACAACATTGCTACTCCCTTTAAGAAACATGTTCATGGTGGCTTCGCTCTATT
TCCCCTTACATTGGCAGACTCTCAAATAATAATTCAGTACATTGCATCTTACTCTAGCCTATAATTAGGTATTTCAGCAGCT
AAACTCTGAATTACCACCCATGGTGCCTTCACTTGGTTCCCCTTACATTGGTGGGTTGACACACCAATGTATGCAGTAGATT
GCATATCATAACAGCAGACCAATAAGTTGATTCTCATTCATTCTCTATTGTCATCATACTGTCAATTTGGGTCTGCAAAAAT
GTCTACCCAAATACACAAAATCTTACACAATTACAAGCTTGAGGAATTGACTTCACTAAATTAAGGCACCCAGCAAAAGAC
AATTGGTGAGCCTTCCAATTAGAGAGGTGTTGATTCACTTTATTTAAAATAAATTGAAAGGAATTCCTCTACACTTTTTTTAT
GAAAATTGGGATTCCCAAATACTCTACCAGGTCATCAGTATGTTGATACCTCATTCTCTGCCAAATAGCCTGCTTTCACTGC
CATCCCACATTATTAGAAAAATAAATACGGGTATTATCATTACTAACCTTTTGGCTTGAGCTCTTAGAAAATAGGTCAATAA
```

-continued

```
TATGAACCATCATCTTCACTTGTTCCTCACTAGCTTCCGCATAAAGGAGAAGGTTATCAACTAACGCCAGATGAGACAATTT
ACGTGTTCTTTTAACTATCTGAATAGGCTTCCACTGTTTTGCATCAATAGCAATTTGAATTAAGTGAATGATGAGGACATGA
CCAAGAGCAAGGGCAAGGATCCACTTGAAGGACTTGGAGGACATATGACAAGGGCTAGAGCAAGGAAAGCCAAGGAAGC
TCTTCAACAAGTACTATCCATACTATTTGAATACAAGCCCAAGTTTCAAGGAGAAAAGTCCAAGGTTGTGAGTTGTATCATG
GCCCAAATGGAGGAGGACTAAATGGCACCACTTTGTCTCAATTTTAGAGTGTTTAGTTTGTCTAAATAATGGCTCAATCCTT
GTAAAGTTGGTTGACCATAAATATGTTTTGGGTTAATCAACTAAAAGAGCTTTAGTTTGGTTTAGTTCAAGTTGTAATAAGG
GCCCAATTGGCAACCTAGGCATCAGCCTTTTGGGAGACCAAATGGTGGCTAGCTTGATGGCTGTTGGGGGTGACTTTTGGTT
GCCACAATTTTAGTTACACTTAGCCATTAAGTTCTTTTAATTCCCTAGGTTAGTGGCATTAAGTTCTTTAATTCTAGGTTAGT
GGATCATTACTAAAATCTGATGTAAAGCTTTTATATAAGCTGAACCATTTTATCAATAAACACAAGTTGAGTTTTATTCAGA
AAAATAGAGTTTATCTCTTTTATCTTAGTGAGAGTGATTCTCCTAAGTTCTTGAGTGATTCAAGAACACCCTGGCTATATCA
AAGGACTTTCACAATCTTTGTGTGTTTCCCTCGCCGGAAAGAGTGATTCTTTCCTTCCTTTCATCTTCAACCTTGTTCTTTCA
AACCACAATTCCAAAAAATCCACTTCTGCCCATAATTATCTCGTGGCCATAACTCCTGTTTTACGCGCTCAAATTAAGTGAT
TCTTGAGCCTAAATTGAATTTCAAAACGAGATCTTTCACCTCGTTTTGGAATCACCTCATTTGGAGCCCTGTATCTTGAGTTA
TTGCCATTTCTATATTTCTGTCCAACCACCACTTAACCTACGTTTTATCATCTCATTCTTCCATTTTATGCCAAGAACCACCT
TATTAAGGCCCACGAAATTAGCCACCGCTCAACCCTTAAATCTTGCAAATTTTCCATCCTTTCCTTAATCAATTTCCGCATTT
TCCATCAAGGTTTAATCCTAGACAATCCTTAGTCAGCCTTTGTGCAATGAAGGTTCATATCATTTGGTATCAGAGCCAAGTT
CTAGGATCAACACTTCCTTTGCTGGAAATATTGGGTAACATCCTTCTTTATTCTCTTTGCCATTTATATTACCTTCTTATTCAT
ATTTTTTAGGCTGAACCATTGCAAAAGTTAAGCCTTTTGATCTCTTTGTTATATATATATTAAAAAAGCAGAAATTCGTATA
AGCAAAATTAAAAACAAAAATTGGGCTGAATGGTTCATGCCTGAAGAACTTAAAAAATATATATATTTAAGGTAATATATT
GGTAGCATGAAGGATTGTTACTTGAATTCCTAAATTCTGAATTTTATTTCCTTCATTTGTGCCTAAAAACATTGTTAGCCTTT
TTCTTGGTTAACCTTTTCCTTGTCTCTCTAGCCTTACCTTACACATATTGGTGAATTGTTCTTTGTTGTGGCCATAATCTCTTG
AATTGCCTAATAACTCAAGGGGAATTAGAGTGGTAAAAGGCAAGAGTGTTTCATTAGAGAAAAGCCATAATTGTGTGATAC
ACTTGAGTGGGTGAGGTATTCAAACAACAACTATAATTGTATTGTTATGTTTGATTTGTTTGTTTGAGATGACAGGAACAAA
TCCTAATGATGAAGTGGGGCTTTCGCAATTCCAAATGCAAGCTTTGATGCAACATTTGGAGAGGTTAATGAAACAACGAGA
TGATGCACTCCATGAGAGGTTGGATCAAATGGAGAATAGAGATCATAATGAAGAAGAAAGGAGGAGAAGAGGGAATGATG
GTGTTCCTAGACAAAACCGAATTGATGGTATTAAAACTCAACATTCCTCCCATTAAAGGAAAGAATGATCTGGAGGCTTACTT
GGAGTGGGAGATAAAAATAGAGCATGTTTTCTCATGCAACAACTATGAGGAGGACCAAAAGGTGAAGCTTGCCGCCACGG
AGTTTTCCGACTATGCTCTTGTGTGGTGGAACAAGCAATGGTTGATACATGGGTGGAGATGAAAATGATCATGACGAAGCG
GTATGTGCCGGCTAGTTACTCAAGGGATTTGAAATTCAAGCTCCAAAAACTAACCCAAGGCAACAAGGGGGTTGGGGAGTA
TTTCAAGTGTCATACCCTAATTTCGTCCGGGAACCTTTGCTCGATGACATGCGACCATTCTTTGGTCCTTGTGAGGTGCTTGG
CACCCATCATTAGGCAATTTATGAAATTCCAGGACATGCCGAAAAACCAAAAAAAATATTGATGCACAATCCGTAAGTTTC
CGTGACACACCGGAAATCAAAAGGAAGCATCGTTGCATAATTAAGTGAGGTTCCGTAACATTCCGTAAGTCAAAAAGGGG
ATGATTATGTAATCCGCAAGGTTCCGTAACATTACGGAAAGAAAACAAGTATCGTTACGAAATTCGTAAGTTTCCGTAACTT
TACGAAAAAGAATCACCAAAAAAACAGCAGAGGGGTGTATTTAGTAAAAATGGGGGTGCAAATAGCACCCAGACCCAC
TTGGGCCCTCCAGAAGATTCCTCCAGAAGGCGGTTGCTTCTGGAGGAAGCAACCCTGCTCGCCTGGGCGAGCTGGGCGGCA
AGCATCTCCCCTATTTTGCTATAAATAGGGGAGAAAATGAAGAAGAAAAGGATCCCAGCCCTTTAGGCACTTCTCTCTCTTT
GGAATTTGCTTGGAAAAATTGTTTCCGTGAAGAAAATCTAAGCCGAGGCGCTTCCGAAACGTTTCCGTAACGTTTTCCGTGA
GGAATCTCGCAAAGGTTTGAACCGTTCTTCGACGTTCTTCATTCGTTCTTCATCGTTCTTCGATCTTCAACGGGTAAGTACCT
CGAACCAAGCTTTTCGATTCATTCTATGCACCCGTAGTGGTCCACATTGTGTTTCGTGCATTTTGATTCTCATTTTGTTTACT
CTTTATACCCCCTGTTGACGTGCTTAAGCCATTTTACTTAAGTCGTTTCTCGCTTAACTTAAAAATAAAATAAATTTCCACCG
```

-continued

```
AACGTTTGAATTGTATTATCCATTAGCTTCGGTTAAAATAAATTCCGACCGTTCGGTCATGCCGTAACCACGTTGGAAATCA
AAAAGAGGTAAAAAATAATATAATAATCAAAAAGACATCTTTTAGTAAAATAAAGCGGAAAATCAATCGGACGTTTTCTCT
TTGGGATTTCTCATTCTTAACCGAATTGATTAATAACTAAAGTGAAACTAAGGCTAACATCAACTCGCCTAGTCAAGCTCGT
CCACAAAAATAAGCTTTTGAAGTTTGTCATTTCAATTTCTCACTAAGTAAAATGGATCATTTTTAAGGTCCAACGCCTTAAA
ATGATCACCACTTAAGTAAAAAAGAATCACTTGATAAGAAAGAACTACGTAGGTCTGATTTTCTCATCCCAAATTGAGGAA
TACGTAGGAGCAAAGGGAAACACCCTTGTCGACCACAAAAAAGGAAAAAATATAAAAAGGGTATAAAGGATATAAGAACA
TAAAAGGGAATAAAAAAATCAAAGTCATGTTTGCACATTCGATTAAAGGCTGCCGTCCCTTGGGACGGGCGTGTGGGGTGC
TAATACCTTCCCCGTGCGTAAATACAACTCCCGAACCTTTCAAACTTAAAAATTCGTAGATCGCGTCTTTTCCGGTTTTTCC
GACGTTTTCCTCAAATAAACGTTGGTGGCGACTCCGCACGTATTCCTTTCGTGGAACACGCATCCCGCGAGTCACGCGTCGC
CCTCCCGCCGAAGGGTAGGTTGCGACATCAAGGAAATGGATGTGCTTATGATTCAAGCAAAGATTGAAGAAGATGAGGAG
GTAACTATGGCTCGATTTCTTAATGGTTTGACTAATGATATTCGTGATATTGTTAAGCTGTAGGAGTTTGTTGAAATGGATGA
TTTGCTTCACAAAGCAATCCAAGTAGAGCAACAATTAAAAAGGAAAGGAGTGGCTAAGAGGAGTTTTACCAACTTTGGTTC
TTCTAGTTGGAAAGACAAAGGTAAGAAAGATGGGCTGCTACTTCTAGTAGTTCCACACCTACCCCATCAAAAACTCGCTC
AAAGTCCCAAGAGGAACCCTCTAAAAGAAGTAGAGATGTGAAGTGTTTCAAGTGCCAAGGCCTAGGACACTATGCTTATGA
GTGCCCTAGCAAAAGGTCCATGGTTCTTAGAGATGGAGAATATATAAGTGAATCCGATGTTGAAGAGGAAGAAGAGAGTG
AGTACGTAGAGGAAGAGGAGACTCCGGAGGGAGATTTGTTGATGATTAGACGGTTACTTGGTGGTCAATTGAAGCATAAGG
AGGAGAGCCAAAGAGAAAACATATTTCAAACTAGATGTTTAATCAATGGCAAGGTGTGCATGGTGATCATTGATGGAGGTA
GTTGCACCAATGTGGCTAGTACTAGATTAGTGTCAAAGCTAAATTTAGCTACTAAACCACATCCTAGGCCATACAAACTTCA
ATGGCTTAGTAAGGATGGGGAGGTACAAGTAAGGCAGCAAGTTGAAGTGGATGTTTCCATTGAGAAATACAATGATAAGGT
ACTTTATGATGTTGTTCCTATGGAGGCCAGTCACTTACTTTTGGGGAGACCATGACAATTTGATAAAAGAGCCAATCATGAC
GGTTACATCAAAAAGATCTCTTTCATGCACCAAGACAAAAATATTGTGCTCAAACCATTGAGTCCACAAGAAGTGTGTGAG
GATCAAAAGAAAATGAGAGAAAAACTTCTTCAAGAGAAAAGAGAAAAAGAAAAAGTGAGCAAAACACTTGAGAGTGAGA
AAAAGAGGGAAACACTTGAGAGGAAAAAGAGTGAACAAAAGAAGAGTGAAACACTTGAAGTGAGGGAGAGCTATTTAGC
CACAAAAAGTGAGGTCAAGAGGTTGTTTCGTGCTAAATAGTCACTATACATCTTGTTTTGCAAAAATCAGATTTTAACCAAT
AACACTTTTGATGATTTTGAAGTGCCTTCTAGTGTTAAAACTCTTTTGCAGGATTTTCAAGACATGTTTCCATCAAATGTGAC
AAGTGGACTACCACCTTTGAGGGGAATTGAGCATCAAATTGATCTCATTCCAGGAGCTTCTTTGTCCAATAGGCCAGCTAT
AGAAGTAATCCACAAGAAACCAAAGAGATTCAAAGACAAGTGGATGAACTCATTAGCAAAGGTAGGGTAAGAGATAGTAT
GAGTCTTTGTGTTGTCCCGGTGATTTTGGTCCCTAAAAAGGATGAGACATGGCGCATGTGTTTCGATTGTAGAGCCCTTAAT
AACATCACCATTAAATATAGGCATCCTATACCTAGGCTTGATGATTTGCTTGATGAATTGCATGGTGCATGTTACTTTTCTAA
AATCGATTTAAAAAGTGGATACAATCAAATTAGGATTAAAGAAGGGGATGAATGGAAAACTGCTTTTAAAACAAAATATGG
TTTGTATGAATGGTTGGTTATGCCTTTAGGCCTAACTAACGCTCCTAGCACTTTTATGAGATTAATGAACCATATCTTGAGA
GAGTTCATAGGAAAGTTCGTTGTGGTGTACTTTGATGATATTCTTATCTATAGCACTTCACTTGATTTGCATATTATTCATTT
AAAATTTGTCTTGTGTGTGCTTAGAGAAGAACAATTGTATGCCAATCTTGAAAAATGCATCTTTTGTACTAACCATGTTGTGT
TTTTTGGATTGGTTGTAAGTTCAAAAGGAGTGCAAGTTGATGAGGAGAAGGTTACGGCTATTCAAGAATGGCCTACACCTA
AGTCCGTGACCGAGGTGAGGAGTTTTCATGGCTTAATAAGTTTTTATAGACGATTTGTGAAGGATTTTAGCATATTGGCAGC
ATCTCTCAATGAAGTGCTCAAGAAAAATGTTGGTTTCAAATGGGAGAGAAACAAGAAGAAGCTTTCAATGTTCTTAAGTA
AAAGCTAACTAATGCCCCATACTTGCATTGCCAAACTTTCAAAAATCTTTTGAAATTGAGTGTGATGCTTCAAATGTTGGG
ATTGGGGCTGTGTTGTTGTAAGAAGGCCATCGAATTGCTTATTTTAGTGAAAAGTTAAGTGGTCCTATCCTTAACTATTCAA
CTTATGATAAGGAGTTGTATGCCTTAGTACGGGCTTTGAAAACATGGCAACACTACCTTTATCCCAAGGAATTTGTCATTCA
TAGTGACCATGAGTCCCTCAAATATATCAAGGGGCAAGGCAAGCTTAACAAAAGGCATGTGAAGTGGGTGGAATTCCTAGA
```

-continued

```
GCAATTCCCTTATGTTATCAAACATAAAAAGGGAAAAGGTAATATTGTAGCCGATGCTCTTTCTCGGCGTCATGCATTACTT
TCTATGCTTGAAACATAATTGATTGGTCTTGAATGTTTGAAAAGCATGTATGAAAATGATGAAACTTTTGGAGAAATTTTTA
AAAATTGTGAAAATTTTTCAGAAAATGGTTACTTTAGACATGAAGGCTTTCTTTTCAAAGAAAACAAATTGTGTGTGCCTAA
ATGTTCTACAAGAAATTTGCTTGTTTGTGAAGCACATGAATGAGGTTTAATGGGCATTTTGGGGTCCAAAAGACTCTAGAA
ACATTACAAGAACATTTTTATAGGCCTCATATGAAAAAGGATGTGCATAAATTTTGTGAACATTGCATTGTATGTAAAAAGG
CAAAGTCTAAGGTAAAGCCTCATGGATTGTATACTCCATTGCCAATTCCGGAGTATCCTTGGATTGATTTATCCATGGATTT
TGTTTTGGGGCTGCCAAAAACAAGCAGTGGTAGAGATTCCATTTTTGTGGTTGTTGATAGGTTTTCTAAAATGGGTCATTTTA
TTCCATGTAAAAAAGTTGATGATGCTTCCCATGTGGCTGATTTGTTTTTCAAGGAGATTTTGAGACTCCATGGTTTGCCAAG
GAGCATTGTTAGTGATAGGGACTCTAAGTTCCTAAGCCATTTTTGGAGGACTTTGTGGGGCAAGTTGGACACTAAATTGTTA
TTTTCAACCACTTGTCACCCACAAACCGATGGGCAAACGGAAGTTGTTAATAGGACATTGGGAACTTTGCTTAGGACAGTTT
TGAGGAAGAACTTAAAAACTTAGGAAGCTTGTTTACCCCATGTTGAGTTCGCTTACAATGGAGTTGTTCATAGCACCACTAA
TTGTTCTCTTTTTGAAGTTGTTTATGGTTTTAACCCACTAACTCCTCTTGATCTTTTGCCTATGCATAATGTTTCTGTTTTTAA
GCATAAAGAAGGTCAAGCAAAGGCGGACTATGTGAAGAAGCTTCATGAGAGAGTCAAAAATCAAATTGAGAGGAGAAATA
AAAGCTATGCTAAACAAGCAAACAAAGGGAGAAAGAAGGTTGTCTTCGAACCCAGAGATTGGGTTTGGGTGCACATGAGA
AAAGAAAGGTTTTCGGAACAAAGGAAATCAAAGCTTCAACCAAGGGGAGATGGACCATTTCAAGTGCTTGAAAGAATCAA
TGACAATGCTTACAAAGTTGAGCTGCCCGGTGAGTATAATTTTAGTTCCACCTTCAATGTCTCTGACTTATCTCTTTTTGATG
CAGATGGAGAATCCGATTTGAGGACAAATCCTTCTAAAGAGGGAGAGAATGATGAGGGCATGACCAAGAGCGAGGGCAAG
GATCCACTTGAAGGACTTGGATGACCTATGACAAGGGCTAGAGCAAGGAAAGCCAAGGAAGCTCTTCAACAAGTGTTGTCC
ATACTATTTGAATACAAGCCCAAGTTTCAAGGAGAAAAGTCCAAGGTTGTGAGTTGTATCATAGCCCAAATGGAGGAGGAC
TAAATGGCACCACTTTGTCTCAATTTTAGAGTGTTTAGTTTGTCTAAATAATGGCTCAATCCTTGTAAAGTTGGCTGACCATA
AATATGTTTTGGGTTAATCAACTAAAAGGACTTTAGTTTGGTTTAGTTCAAGTTGTAATAAGGGCCCAATTGGCAACCTAGG
CATCAGCCTTTTAGGAGACCAAATGGTGGCTGGCTTGATGGCTGTTAGGGGTGACTTTTGGTTGCCACAATTTTAGTTACAT
TTAGCCATTAAGTTCTTTTAATTCCATAGGTTAGTGGCATTAAGTTCTTCAATTATAGGTTAGTGGATCATTACTAAAATCTG
ATGTAAAGCTTCTATATAAGCTGAACCATTTTATCAATAAACACAAGTTTAGTTTTATTCAGAAAATTAAAGTTTATCTCTTT
TATCTTAGTGAGAGTGATTCTCCTAAGTTCTTGAGTGATTCAAGAACACCCTGGCTATATCAAAGGACTTTCACAATCTTTG
TGTGTTGCCCTCGCCGAAAGAGTGATTCTTTCCTTCCTTTCATCTTCAACCTTGTTCTTTCAAACCACAATTCCAGAAAATC
CACTTCTGCCCATAATTATCTCGTGGCCATAACTCCTGTTTTACGCGCTCAAATTAAGTGATTCTTGAGCCTAAAGAATTT
CAAAACGAGATCTTTCACCTCGTTTTGGAATCACCTCATTTGGAGCCCTGTATCTTGAGTTATTGCCATTTCTATATTTCTGT
CCAACCACCACTTAACCTACGTTTTATCATCTCATTCTTCCATTTTATGCCAAGAATCACCTTATTAAGGCCAATGAAATTA
GCCACTGCTCAACCCTTAAATCTTGCCAATTTTCCATCCTTTCCTTAATCAATTTCCGCATTTTCCATCAAGGTTTAATCCTA
GACGATCCTAAGTCTTCCTCTGTGCAATGAAGGTTCATATCAATGAAATAGCCTCTCAATGCATAAAACAAAAGGTAAGG
AGAGATGGGATCTCCCTGTCTAACCCCTTTTTCTAGTCTAAACTCCTCTAGAGGTTCACTATTCCAAAACATACGTATCTTG
GATGAAGAGATGAAATGCCAAATAATGTTCACAAAGTTCTTTGGGTACCCAATATCCTGTAAAGCATCTCGAATAAATGCC
CAATTCAAGCAATCATAAGCTTTCTCCAGATCAATTTTTATTGACATCCATCCATTTGTAGTTTTTTGTGTCTCATTGAATGA
AAAACCTCTTGGGAAATAATTACATTATCTCTACTCTGATGGATGGGAATAAAGTTGACTTGACAAGGGCCAAGTAATTTCT
CCATCAAGGGCCTTATACAATGAGAAAGAACTTTAGTGATAGCTTTGTGGAAAACATTACATAAGCTAATCAGTCTGAAAT
CCTTCAATCTAGTCATATGTTTCACCTTGGGGATAAGAGTGATATGTGTATCATTAATCTGATGCACCAATTACAGATCCTG
AAACACGCTTTGAACCAACTTGACAAGAGCATCCCCCGCTGTATTCCATTGACTTTAATAAAAAAAACTGCATGGAAGCCA
TCAGGGCTAGGAGCCTTAAATGCTCCCATATTCCTAATAATGTTAAGAACTTTTTGTGAAGCACACATCAACTCCAAGGGAA
AAAACAAATTCCTCATCAATTAGAGGAAACATACTTGTTACAGGGAACTCATCAACACACTGATCATCAACAAATAGGTTC
```

-continued

```
TGGTAATATTGAGTCACCATACTTTTCAAAGATTCCCCATCCGAAACCCAGGTACCATCTTCTCCCTGAAGAGTCTCAACTC
TACTCCTTCTCCTCATAATAATAGTAGTTCCATGGAAGTAACTTGAGTTATGATCCCCCAATGAGAGCCATTTGGAATAAGC
TTTCTAGAACCACAAAATCTCTTCCTGTAGCATCACAACCTCATATTCCCTCCACACAGAATACAACATATATGCCTGGGTG
GACTTATCCCTCTCACCCATCCACTTGTTAATTCTATCCATCCGCCTGAGAAGGCTTCATTTCTTAGAGAAAAAAAATTCCT
AAACACATTTTTATTCCAATCTTGCACATCTTTTTGAAACAAACATAACATATCAAACCAAGACAAAAAAGAGTTCCAATG
GGAATGCACAAACCTCTTGAAATCATCATGAGTAATCCATGCAGCCTAAAAGGTCTTGTTTGAGAGTGATGATTCCTTTCCA
CCTCTAATCTAACCAAAAGGGGTCTATGATCCAATTTAAAAGGGGGAAGATGCAGCATCACAGCCTCTTGGAATTTTATTCT
CCACTGCAAGTTAATCAAGAGCCTATCCAACCTCTGTTCAAGGTTGCCTCTTTTCCAAGTATATGGTTACCTTTGAAACCCA
TCATATATTAATTCACAGTTTGAAATCATCTATTGAAAGCTTGTAAGATCACAAAGAGATGGATTGTCAGCACCTCCAACCC
TTTCATGTGGATGAAGAATGGAATTGAAATCACCAATGATAGGCTATGACTTATCAATCTCACAAGCTAACTCTCTCAACAC
ATCCCACATACCCTGCCTGCACTAGTAATGAGAACTATTATAAACCACCATTAATAACCAATCATTAGAACTCTTCCAACTA
ACCTTCAGATGCACATGGTATCTAGAATTTCCCAGCATCTGAACCTTCCATAAGCTTGAATCCCACAAGCAGCAAATACCA
CTAGAGTGGCCCACAACTTCTTCCACAACCCAATCCTTGGATAATTTTCGTGGCCCTTGCACCACTAGAGTGGGTCTCCATA
AAAAATATTAAAGAGGATGGATATTCCCTTTTGATATCTTTAATTAAAGAAGCAAAAACTCTATTGGACATACTGTGACAAT
TGCAAGACAAAAAATTCATGGAGGCATAGCAACATGGATGGCCTTAACATGGCCTTGGCTACCCTCTTGGCAAACTACCAT
ATCATCATTCTCATTTTTGAAACTAGCATTACTACGACCACCTTTAATTTGTGCCTCACCAACAATGCTTGGGTCAGTTGGC
ACAACTTCCTTTTGCCTCTAACGCTAAAGACTGCTTTCTATAGAGCCTTAATCATTTTAAGCTCTTAGTCCCTATCAATAATC
CTTCCCTGTGGTGGTTAAGAAGGTTCTTGACTCACTAAGCTTAAAACCTGTTTTCCCTTCTTAGAGGCCTTCCCTTTATTGGC
AATTCCCATTTTAGTATTTCCCTTTATTTGCTTTTCTTTCGGCTTCCTTAAAACTGGGCCTGTGTTTTAGTTGGCCCAGTTTT
ACCCTCTTCTACCACATAGTTCGTCTTCATCTCCTTAAAAACAACTCCCCTATTCTGTTTCTGAACACCCTTTGGGCCACTAG
TGCTAGGCCCATTAGCATTACGCTTAACTCTAGAGACCAACCTTTCCTCACGTGCTTCATTAAGAGCAATGAATTTTGACCC
AAATGATTTGTTGTTGCGATCCTCACATCCCTGTGCTACAATCTTGGTATGATTGGCAAGGCCAACCCCATTAAAGAGAACT
TTTAACTAATTCTTCCTCACACTCCTACGCACTAATTACCAAGGCCCGAAATGATTGGCATTATCATTACTCAAAACATTCA
CTTGATTTTCGTTTTCAAATCTGGACCATTAATATTATTCATTACGCCATTATCATGCACACGCCACCCTGTCAACTATCTCC
ACCTTAGCCACCATATATCTCCACCAGTTTTTTCGTCCCTCGGCTTTTGTTGGGATTGGATATCCACAACATCGGCTTTCATC
TCCACAGAGTTTGCATCCTTGTACCCATACCTCCCACAATTAAAATAGATCAAATGCAATCCTTCATATTGTAGATTTAATA
AGTAACCTCTAGCAATAATCTTAGGCTGCAAAGGTTTGAATAGATCAATCTCAACACAGATTCTTGTGAAACAACCCCTTGC
TTGGATAGTCATCACTCTGTCGATTTTAAGCATTACTCCAGGAGTAGACCCTAATCTCCATAAGAATTGGTCGTTGAACAAT
TCAATAGGAAATTTTGGGAACCTTATCCACAACCATCCTCCTTCCGACATGCAGATTACCCAAGAGGAAAGGACGCCATCT
TTACACCAGAATATAATGATCAACCACCATCCATGCCGCCCCCCCCCCCCCCCCCATGAAAGCATGGTTGTAATCCTCACCT
CATCAGATGTGAACAAAATCTAATAGTAGTTTCTTGGCACATCAATGATCAATGATCTTGATAGCACCATTCTTTGCCCACT
CACAATTAAACTTGGCCTCCTATTGCTGAAAACCCAATCTCTTCCCCATCACCATGACCATCAAGGACCCCCTTCCATGGCT
TACACCAGTCACTAAACTCCTTATCGGAAATAGGAACTTCTGGGAAACGTTCAAAGTCCTCCTTAGATATTGGCGTAGGAG
GTATTTTCTGATCTAGATACCCAAAACATCTCCCATCAAAAGTTGAAAAAGCCATTGGACCACCATTCTTCAAAAGCTTCTC
TCTATACGTACCATCTGGCACACCTTGCTCGGCCTCCTTATCTTTATCAAGCTCCATCTCCGAATTACCATCACCTTCCTCAT
TAGGCTTCCTATTGACTTTCCTAGTACTACGCTGGATATCATCTTCCTCCTTAGAGGATTCAGAAGAAACCCTAGTAGAACT
CTCAACACCCTCGATTACAAATTATTTATCCCTAGTGGGTTCCTGATGGACATTAACATAGCTATTCATTTATAAGTTACACT
TACATATATTTGCAAGGCATCCATGAATATCTATGGATATTTCCTAAAACTTAAAATATAAAAATAAAAATAAGCAACTAA
ATTATTTTATGAGCTCTGCACAAATAGGCGCTGCAAATATCACTATAAAATGATAAATTAAAGAGTTGGGGAAAATAATCA
CTTTCACAATTTTTTTAATTATTCTTCTATTTTTTTTCCTAAAAAATAGTTTAAAAACCCACAAATTTACATTCCTTTTCTCCC
```

-continued

```
ATATAAGATAAATGTATAAGATTTGTCATATTTCTGGAAAAAAATGAAATTATTCAAATTATCTAAAAATTTCTCTCTTTAA
AGTATAAATTCAAATAAAACTACACGTCGAAACATCAATTATTTATAAGTATATCCATATTAATTATTTATAAGTAAATGCA
CTTTAGTGGTAGCTGGTATCTATGAGTATATGGATAGTATAAAATCCGTTCCCGTTCCATTTACAAATAGGTTAAGAAAAAA
ACCTATTTCAATTAATTATAAATACTCATTTAAATATTCATTTTTCCGTGACAAATTTTACCTGTGAGTATTCACGGGTACAA
GTTTTGAAGTCCTTGCATTGGTTTGCATCTTTTACACGTTTTTTTCTTTCACAAAAAAGGTATTTTTTAATACACATCTTTTA
CAAGTATTTAAGGATTCGTATCAGTTTTTGTCATAGTAGTAACTATTTAGTATCTTTTTTCATTTAAGCTGTCCTCTGCTTATT
CATGATAATGACGGCTAACTGTTAAGTTTCTTCTTGTATCTGTTTTTATTTTATTTTTTCTGACTTTGCCCAACGGTTTATGAT
TGCCGAGCTGCTATTGGTTCCACTAAGCTTGACCCTGTAGGAAATATTTTCCTTTTTGCTAATTTGGAATTATGACTATTGGT
CCAAACATGGAGATAAGATCATTGCATTTATCCATTTTATTGAGATTAATTAAGTCTAAACATAAGTTGAAATCTGCCCATG
CAACCAACGTCCTTTCATTTTAAATAATGACATAATATGTGTCACCGTCGTTGCTCTCAAATTCAATTAACTCAATTGAGTG
AATAACCAAACAACTCGACTGGTAACAGTAACATCAGCTATGTTTCAATTTCAAAGCCTTCTATTCTTTCGAAATCGTATAT
ATATTATGTTCGCCTATTTTATCACGACAACCTTATGCAGAGGGTTTATTTTGTGATGTACGGAAAAAAAAATTATTTATTCC
ATGACTTTAAAATAATTATTATTTTAGATTATTTTATATAAATAAAAATTAATAAATAGATGAAATAAAATAATAATTTCATA
AAATTCGGTATCTTAATATTAATAATTACTTTAAAAAATTAAATATGATATTTATTTTGAGATAAATTTATTTTCAAATATAA
TACTTATTTTAAGAAAAAAATACCTATTAATTATTTCCCACACGAAAGAAGCAGACAAAAGTGTTCAAACGATGCATACA
TGTGGCTGGAAATAAAATATAAATAGGGTTATTTAAACAACTCTTTTTCTATGCTTTTGATTATTGATTAGTTTCGCACCATT
TCTGGCTTCAGATGATACTTGGGGTGTAGATATAAGGGGAAAATAAATTGGGTTGATTAGGTCTAAATATGTATTATCAGGT
TTCAAATTATAGTTGGTTTCGTTCGGTTTTTTTGGGTACATGGCTTGTTTCAGTTTAAATCTGAATATATTAAAAAGATTAAA
ATAAATTAATTAATTTGATTTAACATTTTGATTTCGTAGAACTAAACTAAATTAATGAACAACCTAACTTTCAATTAGGGTAT
CTTTATGCAGGACGGAACGATAAAAAAAAAAATCGAGGAGGGGCAAAAATTTAAAAGCAACCATAATTAACTTTTACTATC
AATAATTATTTTAAACTTTCTTTGAAAGAATAATTATTTAAAACTTAGTCTATTGAAAAAACTAAAATATCATATATCCCATT
GTTATATTTTAATTGTAAAATAAAATATAGTGAAATAGAATGGTGTCTAAATAAGTTACTATTTCATTGTTTAAATATTTTTA
TGATGAAATGAAAAAAAAGAGTATTTCTATCTCATCATTCTTTAATTAAAGGAAAACATATAAATGTAAAATAAAATAAAT
ATATTTTATTTCATTCCATTTAAACAATACAGTTTATTTTTTATTATCGTCTTATTTTAATGTTATTTTGAATAATTAAATAAT
AAAGTTTGATATCATTTTATTTTATTGCGCTTCATTCTATCTTTCTTTCTTTTTAATCAAATTAATCACAAGACTATGGGACCA
CTTCCTTTTTCCTTAATTTTCAATTTTTGCATGCACTTTTACAGTATGAAAGGCATAAGAGAGAGATTGGGGAGCTGCAGCTC
CCTGTTGGACCATTCCATCAATCTTCAAATGTGGAAAAAGAGGTTTGTATAATGTTCTTTCTTCCCATTTTTATTTGTAGATT
CCATGCTCACATGAAGATTACTTTTATTATATCTATTGTTTTCCTTTGTCATTTGAACTTGAATGAAGCTCCTTCTTTCTTTTT
TTTTTTTTTTTGTGCACACACCACTGCAAGAAACAGAGGCACCCAGATATAACTATGTTGCTGCTACGACTGGAGTTTGAG
TTCTTCATTTTTTTTTAGATAATTTTTTTGTTTTTATCTCTAGTTACTGAAATTATCCGAGAGTCTTCATTATATACTGTTGGA
GTTTGAGTCCTTCATTATTAAAATAAATTCTTGGATTGTAAGTGATGATAGGATAAATTGTAGCCACACCATTATTTTATTCT
CTTCTAAGCAACCACACGAGATGGGTTTCATTTCCGAATTTTGACCCTCCCATGTATTAATAAGTTACTCTTGACAAGTTGTT
CGTATATAAATCTACTTTGATTACTTAAACTAGGGAGTTGATAACATATAGATCTACTTTAATTACTTAAGCTAGGGAGTAG
ACACTAGTTATTTTTCTTTCTTTCCATCAATCGTCAATGTTTTGGCTTAAGGCTACCAGAGATAAAAAAAAAAAATGACA
GAATCGAAATAAATAAAATTAAGCAACAACAAAAAAAAAAAGAGATAATACGATGGTTCTTAAATAACCGTCTTAG
AATGTCTTACTTTCTAAGCCGGTTATTTAGGAACCATCTAAAATGTCGCATGTTGATCAAAACATACTAGGACGGTTATTGA
ATAATCGTCTTAGAAAGTAAGACATTCTACGACGGTACCTAAGAAATAGTCTTAGAATGTCTTACTTTCTAAGACGGTTATT
CAGTAACCGTCTTAGATCCGACGACATACTAAGACGGGTTGTTACTCTAAACCGCCTTCGAAAATGGATCATTCTAAGACG
GCTGTTTACTAACCGTCTTAGAAATCTATATTTTCTAAGATGGTTGAAAAACCGTTGTTATAAATATGATGCTATTTTATGAT
GTTGTATTCTATGACAGTTCAAAACCGTCATAGAATGACAAATTTAACCGACTTAGAATATCATATTTGTAGTGGTGTTAGG
```

-continued

```
CTAATATTTCGAATGATGCTACTTGTTTTCCATTGTCCAACATAAAAAAAAAAACCCAAACGTTAGTAATATAGGAAAGAA
AAAATTAAGAATCAAGGATCAATAATAACACCACGAGTCAAGACATTTTCATGATTTTATTTGTGTATTTTTTTATGATTATC
CAACTGAAAATATTAAGCAATACTAAGAAATATCTGGCAAAGCTTCTTAGTATATAATATGAATGACATTGAATTATAAGC
AATTTAATAAGCCTTTGCCTGAGCCTTTTTCATCTTCCAAGACTCGGTTGGATTCTGACTTGTAGAACATGGAAAGAAGAAG
GGTTCTTGGAATCATTGGACTTTGAGAATGTGGAGACATGAGAAGCATCAAAGGAGGATCAAGAAGAATAGATTGTCGATC
TTTCCCAACTTTTCATAGGTAACAAGTTAGCATCCGGTGGTCATAGTATTAAGCTCTTACACTCTATAGTACTGGACTCAATT
GTGAGCCTGTATACAAACACATTAGATGGTTTGTTTGTTTAGCTTTATGGCTTTTTGTTTGTGTAGGAAAACACGAATTCAAC
TGTTTTGAGTTCAAAACTCTAATATGCCTTTCCTTGTTTTATTTTGCTTATGGTTTTTACTTTTTTCTTTTTATATACTCACTGC
CACTTTAGTGTTTTGATGAAGGATAGCATTTGGTTTGAGCTTGAATATACAATATAAATAATCAATAATTTTTTTTTGTTGTT
TATAATAATTTTATCATGTTCAATTAGAATTGTCTTCCCATGATATGGTCAGGGAGCAGAAGGTGAACTTCTGAAATCTCAA
ATAATAAATAGCCTTACAAGACACCAACTTGAACTATTTTTTTTTCTTTCCTTTTGATTTTTGTCGTGTATTTATACGGAGTAC
AACACATATAATACTATATATATTATATGCATATATGTGTGTGGTCATACTTGTCAGTTGCATTTATTATCTTGAACTGCA
GGTGTGTGTGTATTTCCATATATATGAATACGAATGGGTCTTAATTTACACTTTATTGCAGCTTGTAAAAGCTGTGGGTGTA
CTGTATCATAACAAAATACATGTCACAAGGAACTCTGAGGATATATGTATCCGAACAAGAAAGAGTTGTACTCTCTTTCAA
TAGAAACTATACTAATGTTAGCTCTTGACATACTTAGGGGTTATGGAGTATACAAGAACAAAGCAACATGAGTTTTTAAGA
ATAAATCTCCATTGACTTAGTAATGCCACAACACTTAAAGAGTGTCTACCTAAATTTGATGTTCTTGTTTCTACAACTTGTAA
GATGTCATCTCATTACTTTCAAAACTGTCACTTATAAACCAATGTCAAAAAAATATATCATTGTATAGTATATCGCTGGAG
CGTGCATAACATCAAAAGGGACTGAGTTCTTGGTGAGGAACTCTGGACAAATGATTAACAGACCACAGAGATTTATGTTGG
CTTCCCAAATTTGCTGAAGCTTTCAGAGATGCCAATTTCTGGAGGTGGCTAAACAACTAGTTGAATGACGACATTAAAACA
AATCAAGCAGTAGTATCAATTGTAGCTCATTATTTGGTAAGCACAGACCAAAATCATAGCACCTATCAAACCCAAATCTGA
AAAAATGTAGCATTTGTACAAGACATTATACAATGCTACTACTATGTATGTTTATCATTTTCACTCTGAATTATATTTAGCAG
TAAGTCACATGGATTTGGTAAAAAAATAAGGGGGAAAATGTAACGTGTGTAACAGCATGACTTTGATATTTACCCAATTT
TATATTTTTCCCTCCAGCAATAATCCCCAGAGACAAAACTTCAAAAATATTTCAGTATGAAATTGCAATAATGAAGATCAAT
TATTGTTAGTGGATAAAAAAAAAAGTGGGTCCCACACTAATTTTAAAATTATCCACACAAAAGGAAAAACATGTTATTTAT
CACATTCTATTTTTTTCTTCTCCCTTCCTTGTATTTTTCAGCTGAAACAAACACAATGTTACATCTTTGTACAATTTCACTTTT
CCTCTTGTCAAGATTAAAGTCTAGGAATGCTCATGAGTCAGTTGGATGAGACATGATAAGTTAAAGTTGAGAATTTACAGCT
TTGTACATTGTCACTTTTCCTCCTGTCATGATTAAAGTCTAGGAATGCTCACGAGTGGATTGTTGGATGAGACTTGGTAAGT
AAAGTTGAGAAGAACATTCGAATGTCTGGTACAATGCAGGAAATCATGCGATAATACCCGCAAATTGAAAAGTTGGCGACA
TAAATATGATTGAATGCTCCCAGCCACAGATAACAACAGTAAACCATTAAAGTACTATTCGGGCGGTAAAAATTTAACATG
CCATGGTTTCGACCTCAGTTTAAAAAAATTCTTCAGCATAAACAGTATACATGCATGTTTTAATGTAGTAACATTTGAATTC
TTCGACATCTGGTAAACTGTTTTAACATTTTCCACATATATATCCCACAAGAATAGGTTGGTGAGCCATTGGATAAAATTAA
GCCATTGAAAAGCTTTCTACAAAAGAAAAAGAAATAAAAATAGAAGCTTTTATCTACCTGAGCAATAGCTTCTTCACAAAT
ACTCTTAAGGCCATCCAGATGATACTCATATGTAGCCCTTGAGAGGTCCTAAGCAACATCCAAATTAAAATATCAACAATT
CAATTTCAAAGACAAAAGGTATTATACTAGTTTAAATAATGCAACTATGAAAATGTAGAACAGACGGTTCAATGAATAAGG
AAAATAAATCAAAATAAACAAACGGGAAAAGCACACATATGAGTAAAAGTACCTGGGGAGTTGGTAATGGAAAAGCATCA
AAAGGAGAGACTAAACAACTTGCTTTGGCAGCCAATTTGTGAAGTGCTGCTGAAGCATCACCCTTCTCCTTTACGCCCTTCT
CGCTTGAAGATTTAAGAATATCCAATAGCAATTCTAATCATGTACATTTAGCAGCATATTCATTGCAAAATACTTTTACCAT
CATGAGGAGAAGAAAAAAGTTTAAAATCATTTATTATGAAAGAACATCCAAACGTTACAAATCATTTATTACCACTATTGTC
AATGAATATAGTTTTACCATCATGAGGAGAACATAAATAAACAAGAGCAATAGTTACACGTATTTGAAGCCCTTTTTCTAAA
AAGCACATAACAGAGATTAGGTGTTCCAATACCTGCCAAAGAGGAATAGATACAAAAATCATATCCCAATAACGTAAAAAA
```

-continued

```
ACATGAAAAAAATATCGTTCAAAAACTATAAGTAGATTATAATTCTCAATTTCACATCTATAACTAAACTAAATCACTCACA
GAATTTGCACGAAAACTCACTCGCCCTTGAATCTTCTTCTCTAATCTTTTTAATGTGTTTGCTATGCAATCTTTCATAGGCTG
CAAGTTAAACGACAATCACAACAAGGTGTTCTGTTAAGGAACATTAATAATGACTAAATTATAATTTAAGAAGAAATGCAA
CTATATATGGTAAAAATGAAAATCTATTACTTTAATTACAAAGAGTAGATGAACATACAACTAATCTTTAAAATGTCCATCC
TTCGGTTTTTGAAAACCACCAGCCATAATAATATCTACAACAATGTCCTATAATACAAAGATGTTACATCAGTGGCCGCATA
TCACATTATCACTGCACATCGATGATTTCTAAAGGGCAGCACACAATGCTGACAAAGTAAAGAACAAGGAAATTAACTTCA
CCTCATTACCAGCAAGACCATAGAGGGCTAAAGTAGCATCACGTTGAAGGGGAGAATTGTTTGAGTCAATAATATTGGGCA
AAGGCTCTATAGCTCCATTTTAAGCAATAACAGCTACGTGGGTCCTGAAATTTGAATTATATATGCAAAAAAGGGTTATGGA
AGGAAAAATTATAAGAGGAAAAACCAACATATATATATATATATATATATAATTCGTGAAACAAAGGAGCATATTTTTTTA
CACCATTTGTATACATTTACCTATAAATTAAGAAAAATCCACCCTTAAGAGTTAGGTTTAAGAAAGGCAATCCCAAATTCAG
CCATAACTAATGACTGTAGTGTTAGAGGAATCCTAAAGCCTACACCATGGAGTCCCCATTCAACATTAACCATTTGTAAGAT
TGTGTAGTTATATTATGAACACAGCCAAAGGATGGCAATAAACATGTTAATAATTGAATAGAGACTATGATTAGCAATCTAT
ACCTAAGAATAGCATCATGGCTTATCAAATATTAACTTTAAATAGGAGATTATTTGAGAATTTTAGATCAGGCTAATTAATT
ACTGCTATGATAATAAAAAATGCAATTTGAATTTTTAAATTTTATATTCCTTAACATATAAGCAAGCGACTAACTTTTTGTTG
CTACTAATAATCACCTGTGCCAACCTCCCAATTGCAAAAGCCGACATTTCCCGGAGCTCTACATGTGGAGACTTAAGCATG
TAAACTAATGGTGGAATAGCCCCTCCTTGGGAAATATGGAACTACCACAAAGTATGGAAGTCAATAAGAGGATTTCATAAC
TCATAGATTTATCATATTACAAGTTTGCAATGCAGAACTTAATCCACCTTTAAATCTGAATTTGTTGCAGCAAATTGACCAA
GTAAAAGGGCTGCTTGTTTTTTGCTTTTCAAACAACAAGAACTATCATTGAAATTATGAACTTGCAAAGAATACTTGGGGGA
GAAAATAACTAAACCATTAATATGAAGGTAGTATCTGATTTTCAGTAAACAACTATAATGTTCAATAAACATATCATTCTTC
TATATATGGATTGCTTAATGATTAAAGGAAAAACCATGACCAAAGTATAGTGTAACCTAAGTAAACAAACGACAGGTGGTA
AAGCCCCGGCTAGAAGCACTTCTTCATAATATCTGGTGACGAGTGGACCAAATTTTCAATAACAACAACCTACAAAAGGC
GCTAATACAACTAGTGCTAGTAGTTTAGAACTCTGTAGAAGCAAACTAAAAAATGCATGCGATTGTGTAAAGTCATATAAG
CATCTTACCACTACATAACGTATTATAGGATCCTCTGATTGAAGCATTAGTACAAGAGTGGGTAATGCATTGCATCCAACAA
CCTGCAATTTTTTTATTGCAGAAAGTCAACTACCTTTGTGGCATTGAATTCAAGCAATTCAACAAGAGGAGGGATATCACCT
TCCTTCCAGCATATACCATACCTATATAAGCATAAAGAATAGAATAGTTGTAGAATAAATATTTTTAAGCCATGAAAAAAA
GGACAAAATCCTGACACGGGTCTTATTGGTGGTATTTTCAAAGTCAAGATTGCATATTGCATCAGCTACTCTCCTGAGAAGA
CCGATAACTGGAGGAGAAATGGTACTGATCTTGTGCTTACTTAACAAATCTACAAGACAAGGCAAGGCTCCAACATCTATA
ATGAGTTGTTGACGCTCTGGTTGTTTGATGATAAAGATAAGAAAAAATTAAAATCAGAGTTAAGATGCTCCATGATTACGA
GGGATAAACAAACGTGACTTGAAACTGATTTTATTCTTAAACATATTTTTGGAACCCTCGTACCAGAAATTCAAAGACACCC
ATAATCATTTTCCTCTAAAAAAGGGCCACACTATTATATACTACTGAAAACTCAAATAGAAAACACATAGAGACGTTACAT
GCACGCAGTATGGTTGATGTATTTAATCCAATACACCCATATTCTTCACTTATATGTTAATTTGGATAGTAATTTGTATTATT
ATTTATTCAAAAATCACCCTTAAAATTATCAAGACTCTCCATCTCACTTTTTCATTTAATTAATTAATGTGTGCTAGTCATGT
TATTGGATGCATCCAAGATTTCATGGGCCGATAACAAAAAAAATAATTTGTACCCTTTTATATTTAAGTATTTGAAAATATA
AAGATATATTATTTAAAAAAAGTGGATACATAGTTTGATTAAAAATTACATTTTTTTACATTAAACAAATAACATAGGTTTA
ATGAAACTCAAAATGATATATATATATATATATATATATATATATATATATATATATATATATATATATATATATATATAT
ATATATATATATATATATATATATATATATATATATATATATATATATATATATATATATATATATACCTATAGATATCCA
GATATATCTGTATCTCCCCCTCCCTCCCTATCCATTTTTCTATATCCACCCTTCCCCCGCCCTTTTTTCCCCCCTTTTCCCC
CTTCCCCCTTCTCGCCCCCTCTCCACGTGTAGGGACCCACCTAGATCCAGTTATGCTCTAGCACCCCCCCTCCCTGCGTCTT
CCATCCTTTTTCCAGCGCCTTTCCTCTTTTCCCCCCTTTCCCCCAGCTCCCACATGCACCCCAGGGGCGGCCCTGTCTCTCC
CCCGCAACTTCCCCTCATTTCTCGCCCCTACTCTCGCCCCGCCCTGGCGACGCCCCCCTCCCCACCCCTCGCCACACCCTCT
```

-continued

CCGCTGTCCGCGACGTTCTCCTACCCCTTCTCGCCCGCTGGGGTGTAGACACCTCCTCTCCCCCCCCCTCGTTGCCTCTCTTT

CCCGCGCGCGGCTGTCTTTCTCCTATCTGACCTCACACGCTTTCCCGCAGGGGTCTTTCCTTTTGTTCTCGCCCGAGGCCCC

CTGGCCGTAATCCATGTGCCGCCTAAATCCCCGTTTGTTGCGCCCACGCTACTCCTTGTTGCTCCCCCCTGATAACTGTTCC

CCCCCTTGCCGCGCGGCGTATTATTACAATTCTTATGTCGTCTTGTCTTTCTCTTTTCTCGTCCCCGCCCTTTAGTGTCGGCTA

GTTGGCCCGCTTTTTTCTTCCTCTCTCCCCC

>BAC99.FASTA.SCREEN.CONTIG6 (SEQ ID NO:182)
ATTTAGGTGACACTATAGAATACTCAAGCTTAGCCCTAGAGGGGATGGACCTTTCCAGGTTTTGGAGAGGATCAATAACAA

TGCCTATAGGTTGGACCTCCTAGAAGAGTATGGAGTCAACACCACTTTTAACATTTTTGATTTAATTCCTTTTGAAGGTGGA

GCTGATATTGAGGAGGAGGAACTAACAGATTTAAGGTCAAATCCTCTTCAAGGGGGAGGGAATGATGCAATCCTCCCTAGG

AAGGGACCAGTCACTAGAGCCATGAGCAAGAGGCTCCAAGAGGATTGGGCTAGAGCTGCTGAAGAAGGCCCTAGGGTTCT

CATGAACCTTAAGGTAGATTTCTGAGCCCATGGGCCAAGGTTGGGTCCAATTATCTTTGTACATATTAGATTAGGATGTCAT

TATACTTGGTCCTTGTATTTAGGGCTCCATAATGTAGGTAGGATACCCTAGAAATATAGGATTTTTCAACCCTTGTATTTTAT

GGCACCTAGACTAGTTTTTGTATTATGGGTAGTTTTGTAATTTCACATTCACTAAGTGAATATTTGATGTGTGTGTTGAGAAA

TAAATTTAATTGAATTGGTAGAAGCCCAATCCAATTAAATTTTAGAGGGGGAGGTGAGCATTTGCTTACTACACCCCATTGC

CACATCATATAGTCATACTTTGTGCATGTCCTTCATGCTTTACATGCCTCATGACACCTAAGCACAATTAGTGGCGAATCTT

GGAATTGATCTTGGATTAGTGGGCTGAACCATAACTGCAATTCACTAATTATAATTAGTGAAGTTTTGGCTCCAAAATTTGG

CTCCATAAATTCAAGTGAAATTTGAATTTCCCTCCAATTTTGTGTGACACTTGGGCTATAAATAGAGGTCATGTGTGTGCAT

TTTTTTAACTTTGATCATTTGAAAATTAAACTTCAGATTTCAGAGCTCTTTTAGAGCACAAAAATTTTGTGCTCTTCTCTTCCT

CTCCCTTCATTCATCTCTTTCTTCCTCCAAGCTCTTATCCATGGCCTCCTATGGTTGTGAGCTTCTTCTAGACTCATCTTCTCC

TTGAAGTGGCATCTTCTTTCTCTTTTCCTTCTCCATTCCGCTGTCATTCATCTTCCTAGGCCTACAAGCTCCAATGGAGCTTA

CATCATTATATAAAGAAGGAACAAGAACAAAATAGATTTAATATGTTTCAAGAATCTGCAATGAATAAAATCAAAGAAAAG

AAATTTCACACACTAACAGAATCGTAATTTATATATAATTAAATTAATAACAAGTAATGACTAATCCAATTTAGTCAATGAC

CAATCAATACATCTATAAATACAACTACTAATTCTAATCTTGGAGCCTACACTAATACAAAGATAGTGTAAATTAAAAGTCT

GAATTAAATTGGTAAAAACAAAATTTTTCATTAAAAGATGGGTGTAAGAGTTTTTACTCGCTTAAATTGACGGTTACACAAC

CATCTTTATTTTTTAAAAAACAAGAAACAATATTCCTAATAAAGAAAAAAGTCGCTTAGCATCAATAAGATCCCACAATTGA

ATCCAATATATAAAAATGCAAATACAAGGTGATTATTAACTTGGGCCTGAGACCCACAACAACTAAATTAACCTATAACTC

AAACCCCACAATATTAATCCATTATGTACCCAAACTACCTTTGAGTCCATCGGTAAGCAAAAAAAAAAACAAACAAGGATC

ATTCACAGCTTAATTTAAACTTAGATTGAGAAGTTCACATGAATTATCAAGTTGGGCTTAAAACCCCACGAGTACAAAAAA

AAAACCAAACCCAATGAACACATTTTCCACCCACGAAGACAATACAAAGGTACTACACATTGATACCAATCATCCCCAAG

CTTAGTATTCCCGAACTATGGATATGATATGACAGAGATACAAAATTTGTGATTAAGATTAAAGAATCATAAGATTCAGCTT

CTTCAACTAGCTTAGCTTAAAACCTTTTTGGACCATGTTTCGTGTTAGGAATAGAGAGCACACTTTCAGTACGAATATGAGT

CAGTTAATACACCAAACATCGCACATTTTCAAGAACAAAGAGCACATTTTAGACATGAAGCAAAAGCATTTCTCAATGAAC

ACATTTTCAGGTACTAACCTGGGGAGGAAGTCACGAGGGAATTGGACATGAAACAAAGAAGGCTTCAAGTCGCAAGGTA

GAGATAATACAAAACAATGACGAGGTCGCAGCAAAACATGGGTGAGGCAGTGACGGTGTTACAGTAGAACGCGGGAGCAC

CTTTGTAATGACCCGCCTCGTCGTTACGATATCACCACTCTAATAACTGAAAAATTAAATTCTTTTTCTTTCTTTTATGAAAA

CTCCATTATTTTTACTTATGAAAATCATAGTAAATTTGAATTTCACAAATATATATATATATATATATATATATATATATATA

TATATATATATATATATATATATATATATATATATATATTGTCCCCAAACACGCACCAATGTTTGACCGAATACATGAATATTAT

GTCATTCATCCACAATAGATATCGCATCCCATTCGTTAAAAACATAGTTTTTCTTGAAAGAAAATCAGCATGCAATAGGG

ACATGCAGATATTCTCAGAGCTAGGTTCCCTGACCCTAACTATGGTGTCAAAATAGTAAATTTTATAATAACTCCCCTCACC

TATCGTGAGCTCTCCGTCAGTTTCTCTTTGCATCACTTAGAGGTCTCTCTCTCGTTCACGCTTGTCAGTCCAACGCAAGTCTC

-continued

```
TATTACACCAAAACAAAAGGAATTTAGCATAGGCTTCAAAAACAAGATCAAAGGAAACATTCGGGGTCAAATACCACTGT
CAAAACATAAGGGATAGAGGGGTATTTCGGGTTCTACAGAAAAGAAACATCTTTTTGAAATTCCGATCACGCCAATGTGAC
CGGGGTTTAGTGAATGCCGCAAAAATAACCTCAAGGTCATAAAAAGATAACTTTTACAATGTCTCATTCTCTAGGATTTTTC
AAAGGAAGTGTAAAAACACCCTATAACAGTACCCAACACATAAGAGACACTAAGAGGAACTCAAACTAGCTAGGAGAAGG
CTTAGAAGTCAAGGTTACCTTAGAGAAACTTTGAAATGGAGGATTGAGGGATTTTCTCCACCGAATTCTGAGGATTCTGCTC
TGATTAAAGTGTTCCTCTTGGTGTGGGGGTCCAACGGCAAGCAACAGCGGCTCATAGCGGCCACTGGTGGTCTTGGGTGGT
GGAAAATAAGGTTTTAGGGTTTGGGAGACGTTTTTGGGGGAAGAGGTGAGTGAAATTGTGTTTTTCACGCTAAGGACGTATT
TATAACCTGCAACATTTGCTTAGCGGGCCTTCTGGGCGCTCAGTGCACTTCCTCTCGGTTGGAAATGGGCTTAGTGCAGCTT
TGGGCCGCTCAGCACAATTCCCCTCGGTTGGAATTGCGCTTAGCGTGCCTTTCTCGCTTAGCGGGAGACTAAAAGTTATTAT
TTTCAAGATCCCAACGGTCAGACAGTAGGAACATATCTTAGGGATATCCAGACAAAATTTGAAGATGATGCAACAGTTAAC
GAATCTGGTGTCGCGATTTCATTGAACTAGGTTTTGGTAAAATCTAAAATCTCATACTTTCAACTTAGCTCAACAAAACTCC
ACATAATTCAACATCCATATCAAGAAATTCACACATGACTAGTTCAAGGCATACTTCAACTCATTCAAGTCTATCATGTAGT
CAAATAACACAACAAAATAATCAAACATCAAATATAATTACTAATAATATATATATCAGGGTGTTACAACCTTCGCGAGTG
ATGGTGGTGAGACTGAGCACGAGGACCTTCGCGAAGGAGAGGACTGTCACGAGGGTGAGAGTGAGAGCTCTGGTGAAGGG
TGAGAGTGAGAGCGAGACTGAAGCGCCATGGACAGAGAGAGTGAGAGTGAGAAGCACGAAAGAAAATTATAAATAGGAT
AGCACAACGTTGGTTTTTTCCAAAAATCAATGTTAACGCGTTTTGTTAACAACAATTTTTCAAAAAAAATGATGTTAACAAA
AGTTCATTAACATTGATTTCTAAAAAACTGATGTTAACGAACTCACATCGGTTTTTGAAAAAACCGATGTCAACGAATTCAT
GTTATTTATGATTATGCCATCGTGTTTTCATTAACATCGATTGTATCGAAAAATGATGTTAGCCTAGCGATTTTAAAAGTATA
TTTTCTAGTAGTGGGAGTAGACAATGGCCATGAAATACCTTTCCGACATTTTTGTTAGAAGCAGCGAGTGACAACATCGTGC
ACATGGGAAACCTAGATCTATTTTTTGAAGATATCATAATACCGACCATTGTTTCTTCTTTGTGACACCCCTATTTATCCTTC
ATAGGCGAATGTTGATGGTGTTGGATCGAGTGGCCTCAGAATAATTAAGAAGGGAGGGTTGAATTAATTATTCCTAAAACT
TTACCAATTAAAAATTACTCTTTTAAGGCTTTTACTTTTGTTGTTAAGAATATGGAGTAGAAGAGAAACTTAACAGAAAG
TAAAAGCGAAAATTAAATGCACAACGGAAAGTAAAAGAGTAGGGAAGAAGGAAACAAACACACAAGAGTTTTTATACTGG
TTCGGCAACAACCCGTGCCTACCTCCAGTCCTCAAGCGACCTGGGGTCCTTGAGATTTCTTTCAACCTTGTAAAAATCCTTT
TACAAGCAAAGATCCACAAGGGATGTACCCTCCCTTGTTCTCTTTGAAACCCTAGTGGATGTACCCTCCACTAGAACTAATC
CACAAGAGATGTACCCTCTCTTGTTCTCAGTCAAACCCAAGTAGATGTACCCTCTACTTGTACCACAAAGGATGTACCCTCC
AATGTGTTAAGACAAAGATCTCAGGCTGTTAAACCTTTGATACTTTGTGAATGGGGATACAAAAGAATTCTCAGGCGGTTA
AACCTTTGAACGCTTTTGTATTAGGGAATGGGAAGAATCAAAAGAATTCTCAGACTGTGTCATTTTGAATTCTTTGACAAGG
GAGAAGGGAGACACAAAAGAATTCAGGCGGTTAGTCCTTTTTTCTTTAGGAAAAGGGAGAAGAGAGACACAAAAAGAATT
CAGGCGATTAATCCTTGGCGAATGGCAAAGGGAGAAGAGAATGAAAAGGATGAATAGCACAGGTTTTCAAGGTTTAGAAA
ACCAAAAAACTTCAGAAAGCTTTTGGTACAAAGAAGAAGAAGAAGTTCAAAGAGATTCAAGGCTTGTAAAGGATTGTATG
AATAATTGTTCAAGATTGTTGTTGGAAAGATTGATTCGGAATGCAAAACAAAGCCTTGCTTTTATAAACTCTTGATGTCTGG
TCAAGAAGGCCATTCAGAAGAGTTATAACTTTTTAGAAAAACTTAAAACCCATTTGAAAAAGTCAAAACCTTTTTGAAGAG
TTACATCTTTAGATTTTTCAAAAACAAACACTGGTAATCGATTACCAAATATGTGTAATCGATTACACAAAGCTTTTGAGTG
AAACAATGTGACTCTTCACTTTTAAATTTGAATTTCAACGTTCAAGGACACTGGTAATCGATTACCAAAACATTGTAATCGA
TTACAGCCTTTTGAAAATATTTGGAACGTTGTAAATTCAGTTTGAAAACTTTTTCAAACTCATTTTCCTACTGGTAATCGATT
ACAACAATATGGTAATCGATTACCAGAGAGTAAAAACTCTTTGGTAAAGGTTTTGTCAAAAACTCATGTGCTGTTCAAAGTT
TTGAAAAACTTTTTAATACTTATCTTGATTGAGTCCTTTCTTTATTCTTGAATCTTGAGTCTTGAATCTTGATCTTGATTCTTG
AGATCTTGCATCTTGAATCTTGATTCTTGATTGTAGGCTTTCTTCTTGAGTCTTGAATTCTTCTTGATTCTTGAACTCTTGACT
TGTTCTTGATTCACTTGAGATGTTCTTTGATTCACTTGAGTTTTTCTTTGATCTTTTGAGCTTTTTGTTCATCACCTTTGTCATC
```

-continued

```
ATCTTTTGTTGTCATCATTGTTATCATCAAAACACCTTTGAATCATTGTTGATTCATCATGAAGCTTTGCTTCCACAATCTCC

CCCTTTTTTATGATGACAACTTCAGAAATCAAGAAACACACACACTTTTTCCTAGTCGATCACTCTTATAAATGCTCCCC

CTTTGTTTTTGAATTTATGCTTATCTTAAAATTAAATTATTTACTCATGTGAGTTCTTGATTTATCCCTATTTCTCTCCCCCTTT

GGCATCAACAAAAAGCCAAAGTGTGTATTTAAACTTAAAGTATGCAAATATATCTTAAACATTCATACAGCATTCATAAAA

AATATTAACCACAACATGAAGTAAAAACCATGAAGTAACAATCATAAATAGATTAACTTATAAAATCCACATAGTCAAATA

AGATACTTGTTCAACCAAACCATGCAAATAAGGAAATAATAAATTGTTCAAATACCATAGTAATATAGCCAAAATACAAGG

CTGAAAATCAAAGTAGTAATATTAAAATATAAGTCTAAGATGATGGTGGCGGCGGTGGTGGAAGATCAAAGCTTGACCGGA

TGTAAGATACATCTTCTTCAACCTTAGTCATTCTTGACTCCATTTCATTGAAGCGCATATCCACTTGCAGTTCCAAAGTATCA

AACCTCTCACCAACAAAGGTTTGAAGACCATCAAACCTTTCCAAAATCTTCGAAAGAAGAGATGAATCTTCTCCCTCATGA

CCTTCTTCACCAATATTTCTAGCACCCTTCTTTACCCATGATCCATCATGCTCCTTAATATAACCAAAGGATGCTATGACTGA

AGCGCCTATAAGGAATGATCTCTTGATTGGAACATAAGGTTCAGAATCAAGAGGGATGTTGAAATGTTGAAGGAAGAGGGT

AACAAGGTGAGGATAAGGCAACGGGGCATTCAATCGCAACGCCTTATGCATGCGATATCTAACAAGATGTGCCCAATCAAT

TTGTAAACCTTTATGAAAGGCCCACATGACAATGAGATCTTCTTCAAAAACCTGGGCAAGGTTTGAAGATCTAGGAAGCAA

AATGCGAACTATAAGGTAATGGAGGATGCGGCTTTCAAAAGCCAATGAACCAGCAAGAAGTCTTCCAGTCATATCCGCTTG

GTTGGTGCAAACCAATCGGCGGGCATCATGCACAGAGAAATCGAATTTCCATTCATCAATCAGTGCACCCTCAAAAGTCAT

ACCTTCACTAGGCAATTTGGTTAAGTCAAAAAACAGGGATTGGTCAATGACCATCTTAATCCCATAGATTTCAGACATTAGA

ACACCTTCATGAATTTCTAAATTAGAATAGAAGGCTTTTGTTAGTGCTTAGCTTTACTTAGTTTTAAAAGATTGGCTAAAATT

TTGTTAAAACATAAAGCACTTAGACAATGAAGGAAAGCTGGAGTTGCTGCACATGATGTCTAACATTATGTCAAGGAATCA

GATTGGGGTGCACAATGCACAAGGCAAGATAAAATGTCAAATGAAGAATTGAAGCTGCAGGATCCACGATGTCGGATACA

ATGTCCAGGACATCCTGCCCGAAAATACTGGACACATAAATCTGTTATATCTTTAACAGATTAATGTGCAGTCAGCAACAG

ATTAGGAGCTCTATCTTTAGGAACGAATTAAAAGATAATTAAAGATTGAATTACAAACTTGAATAGTTTCGTTCAGGGATTA

GAGATTGAAGATAAAAACTAAAAGATAAAACTTTATCTTTTAGATCTTTAAGTGCAGATTTTTCAGGAGAATGATAGAGCTT

ATCCAGCGGAAGTTGTTGCAGCCCAGATACGTACACTGCTATATAAACATGAAGGCTGCACGGGTTTTTTATCAAGTCAGA

GATTGAAGAGTTATTTTGTGAGTTTTGTGACTTGAGTGTTTTGTGAGCCACCTTGATGTTACCCTAACATCAAGTGTTGGACC

TGAGTGTGTAGAGTTGATCTCTATTGTTCAGAGAGCAATCTCTGGTGTGTCTTTGATTTGTTTGTAAACACGGGTGAGTGATT

GAGAGGGAGTGAGAGGGGTTCTCATATCTAAGAGTGGCTCTTAGGTAGAAGTTGCATGGGTAGTGGTTAGGTGAGAAGGTT

GTATACAGTGGCTGTTAGATCTTCGAACTAATACTATTTTAGTGGATTTCCTCCCTGGCTTGGTAGCCCCCAGATGTAGGTG

ACGTTGCACCGAACTGGGTTAACAATTCTCTTGTGTTATTTACTTGTTTAATCTGTTCATACTGTCATATACAATCTGCATGT

TCTGAAGCGCGATGTCGTGACATCCTGTACGACATCTGTCCTCAGTATCAGAATTTCAATTGGTATCAGAGCAGGCACTCTA

AATCACTGAGTGAGATCTAGGGAGATAAATTCTGATGAACATGGAGAAAGAAGGAGGACCAGTGAACAGACCACCAATTC

TGGATGAACCAACTATGAATACTGGAAAGCAAGGATGGTGGCCTTCCTCAAATCACTGGATAGCAGAACCTGGAAAGCT

GTCATCAAAGGCTGGGAACATCCCAAGATGCTGGACACAGAAGGAAAGCCCACTGATGAATTGAAGCCAGAAGAAGACTG

GACAAAAGAAGAAGACGAATTGGCACTTGGAAACTCCAAAGCCTTGAATGCCCTATTCAATGGAGTTGACAAGAATATCTT

CAGATTGATCAACACATGCACAGTTGCCAAGGATGCATGGGAGATTCTGAAAACCACTCATGAAGGAACCTCCAAAGTGA

AGATGTCCAGATTGCAACTATTGGCTACAAAATTCGAAAATCTGAAGATGAAGGAGGAAGAATGCATTCATGACTTCCACA

TGAACATTCTTGAAATTGCCAATGCTTGCACTGCCTTGGGAGAAAGGATGACAGATGAAAAGCTGGTGAGAAAGATCCTCA

GATCTTTGCCTAAGAGATTTGACATGAAAGTCACTGCAATAGAGGAGGCCCAAGACATTTGCAACATGAGAGTAGATGAAC

TCATTGGTTCCCTTCAAACCTTTGAGCTAGGACTCTCGGATAGGACTGAAAAGAAGAGCAAGAACCTGGCGTTCGTGTCCA

ATGATGAAGGAGAAGAAGATGAGTATGACCTGGATACTGATGAAGGTCTGACTAACGCAGTTGTGCTCCTTGGAAAACAGT

TCAACAAAGTGCTGAAAAGAATGGACAGGAGGCAGAAACCACATGTCCGGAACATCCCTTTCGACATCAGGAAAGGTAGT
```

-continued

```
GAATACCAGAAGAAGTCAGATGAAAAGCCCAGTCACAGCAAAGGAATTCAATGCCATGGGTGTGAAGGCTATGGACACAT
CAAAGCTGAATGTCCCACCCATCTCAAGAAGCAGAGGAAAGGACTTTCTGTATGTTGGTCAGATGATACAGAGAGTGAACA
AGAAAGTGATTCTGATAGAGATGTGAATGCACTCACTGGGAGATTTGAATCTGATGAAGATTCAAGTGATATTGATATTGA
AATCACTTTTGATGAGCTTGCTATATCCTATAGAGAACTATGCATCAAAAGTGAGAAGATTCTTCAGCAAGAAGCTCAACT
GAAGAAGATCATTGCAAATCTGGAGGCTGAGAAGGAGGCACATGAAGAGGAGATCTCTGAGCTTAAAGGAGAAATTGGTT
TTCTGAACTCTAAACTGGAAAACATGACAAAATCAATAAAGATGCTGAATAAAGGCTCAGATATGCTTGATGAGATGCTAC
AGCTTGGGAAGAATGTTGGAAACCAGAGAGGACTTGGATTTAATCATAAATCTGCTGGCAGAACAACCATGACAGAATTTG
TTCCTGCCAAAAACAGCACTGGAGCCACGATGTCACAACATCGGTCTCGACATCATGGAACGCAGCAGAAAAAGAGCAAA
AGAAAGAAGTGGAGGTGTCACTACTGTGGCAAGTATGGTCACATAAAGCCTTTTTGCTATCATCTACATGGCCATCCACAT
CATGGAACTCAAAGTAGCAGCAGCGGAAGGAAGATGATGTGGGTTCCAAAACACAAGATTGTTAGTCTTGTTGTTCATACT
TCACTTAGAGCATCAGCTAAGGAAGATTGGTACCTAGATAGCGGCTGTTCCAGACACATGACAGGAGTTAAAGAATTCCTG
GTGAACATTGAACCTTGCTCCACTAGCTATGTGACATTTGGAGATGGCTCTAAAGGAAAGATCACTGGAATGGGAAAGCTA
GTCCATGATGGACTTCCTAGTCTGAACAAAGTACTGCTGGTGAAGGGACTGACTGCAAACTTGATCAGCATCAGTCAGTTG
TGTGATGAAGGATTCAATGTAAACTTCACAAAGTCAGAATGCTTGGTGACAAATGAGAAGAGTGAAGTTCTAATGAAGGGC
AGCAGATCAAAGGACAACTGTTACCTATGGACACCTCAAGAAACCAGTTACTCCTCCACATGTCTATCCTCCAAAGAAGAT
GAAGTCAAAATATGGCATCAAAGATTTGGACATCTGCACTTAAGAGGCATGAAGAAAATCATTGACAAAGGTGCTGTTAGA
GGCATTCCCAATCTGAAAATAGAAGAAGGCAGAATCTGTGGTGAATGTCAGATTGGAAAGCAAGTCAAGATGTCCCACCA
GAAGCTTCAACATCAGACCACTTCCAGGGTGCTGGAACTACTTCACATGGACTTGATGGGGCCTATGCAAGTTGAAAGCCT
TGGAGGAAAGAGGTATGCCTATGTTGTTGTGGATGATTTCTCCAGATTTACCTGGGTCAACTTTATCAGAGAGAAATCAGAC
ACCTTTGAAGTATTCAAAGAGTTGAGTCTAAGACTTCAAAGAGAAAAAGACTGTGTCATCAAGAGAATTAGGAGTGACCAT
GGCAGAGAGTTTGAAAAAACCAAGTTTACTGAATTCTGCACATCTGAAGGCATCACTCATGAGTTCTCTGCAGCCATCACA
CCACAACAAAATGGCATAGTTGAAAGGAAAAACAGGACTTTGCAAGAAGCTGCTAGGGTCATGCTTCATGCCAAAGAACT
TCCCTATAATCTCTGGGCTGAAGCCATGAACACAGCATGCTATATCCACAACAGAGTCACACTTAGAAGAGGGACTCCAAC
CACACTGTATGAAATCTGGAAAGGGAGGAAGCCAACTGTCAAGCACTTCCACATCTTTGGAAGTCCATGTTACATTTTGGC
AGATAGAGAGCAAAGGAGAAAGATGGATCCCAAGAGTGATGCAGGAATATTCTTGGGATACTCTACAAACAGCAGAGCAT
ATAGAGTATTCAATTCCAGAACCAGAACTGTGATGGAATCCATCAATGTGGTTGTTGATGATCTAACTCCAGCAAGAAAGA
AGGATGTCGAAGACGATGTCAGAACATCGGGAGACAATGTAGCAGATACAGCTAAAAGTGCAGAAAATGCAGAAAATGCA
GAAAACTCTGATTCTGCTACAGATGAACCAAACATCAATCAACCTGACAAGAGTCCCTCCATTAGAATCCAGAAGATGCAC
CCCAAGGAGCTGATTATAGGAGATCCAAACAGAGGAGTCACTACAAGATCAAGGGAGATTGAGATTGTCTCCAATTCATGC
TTTGTCTCCAAAACTGAGCCAAAGAATGTGAAAGAGGCACTGACTGATGAGTTCTGGATCAATGCTATGCAAGAAGAATTG
GAGCAATTCAAAAGGAATGAAGTTTGGGAGCTAGTTCCTAGACCCGAGGGAACTAATGTGATTGGCACCAAGTGGATCTTC
AAGAACAAACCAATGAAGAAGGTGTTATAACCAGAAACAAGGCCAGACTTGTTACTCAAGGCTACACTCAGATTGAAGG
TGTAGACTTTGATGAAACTTTCGCCCCTGTTGCTAGACTTGAGTCCATCAGATTGTTACTTGGTGTAGCTTGCATCCTCAAAT
TCAAGCTGTACCAGATGGATGTGAAGAGCGCGTTTCTGAATGGATACCTGAATGAAGAAGTCTATGTGGAGCAGCCAAAGG
GATTTGTAGATCCAACTCATCCAGATCATGTATACAGGCTCAAGAAGGCTCTCTATGGATTGAAGCAAGCTCCAAGAGCTT
GGTATGAAAGGCTAACAGAGTTCCTTACTCAGCAAGGGTATAGGAAGGGAGGAATTGACAAGACTCTCTTTGTCAAACAAG
ATGCTGAAAACTTGATGATAGCACAGATATATGTTGATGACATTGTGTTTGGAGGGATGTCGAATGAGATGCTTCGACATTT
TGTCCAACAGATGCAATCTGAATTTGAGATGAGTCTTGTTGGAGAGCTGACTTATTTTCTGGGACTCCAAGTGAAGCAGATG
GAAGACTCCATATTCCTCTCACAAAGCAAGTATGCAAAGAACATTGTCAAGAAGTTTGGGATGGAAAATGCCAGCCATAAA
AGAACACCTGCACCTACTCACTTGAAGCTGTCAAAGGATGAAGCTGGCACCAGTGTTGATCAAAGTCTGTACAGAAGCATG
```

-continued

```
ATTGGGAGCTTACTATATTTAACAGCAAGCAGACCTGACATCACCTTTGCAGTAGGTGTTTGTGCAAGATATCAAGCCAATC
CCAAGATAAGTCACTTGAATCAAGTAAAGAGAATTCTGAAATATGTAAATGGCACCAGTGACTATGGAATTATGTACTGTC
ATTGTTCAGATTCAATGCTGGTTGGATATTGTGATGCTGATTGGGCTGGAAGTGCAGATGACAGAAAAAGCACTTCTGGTGG
ATGTTTCTATTTGGGAAACAATCTTATTTCATGGTTCAGCAAGAAGCAGAACTGTGTGTCCCTATCTACTGCAGAAGCAGAG
TATATTGCAGCAGGAAGCAGCTGTTCACAACTAGTTTGGATGAAGCAGATGCTGAAGGAGTACAATGTCGAACAAGATGTC
ATGACATTGTACTGTGACAACATGAGTGCTATTAATATTTCTAAAAATCCTGTTCAACACAGCAGAACCAAGCACATTGAC
ATTAGACATCACTATATTAGAGATCTTGTTGATGATAAAGTTATCACACTGGAGCATGTTGCCACTGAGGAACAAGTAGCA
GATATTTTCACAAAGGCATTGGATGCAAATCAGTTTGAAAAACTGAGGGGCAAGCTGGGCATTTGTCTGCTAGAGGAGTTA
TAGCAGTTACTTCTATCTGAACGTGCTCAAACTTCTCACTTAACATTAATAGCACGTTCACTACTGGGCCAAAACAAATTCA
ACCTCCGTTTCACACGTTCTCCTACATTCCTCATTCAAACTTACATTTTCGTGGCAATCTCGTTTTCATCAGCATTCCCCAAC
ACTTCTCAGATATTCACGAAACCACTCCCAAAGCTCTGCTTCTCCATGGCTACCTCACCAAAAGAAACCTCATCCCCTGTTT
CACCCTCTGTACCATCATCTCCATCATCCTCCAAAACTCCATCAAACCAGGAACAACCTGCACTCAATATCCAATCCATAC
AAATGATTCCTGGTCCAGGCCCTGTTCCTGAGAAACTGGTCCCTAAAAGACAACAGGGAGTGAAGATTTCTGAAAACCCTA
GCTTTGCAACAAGCCCTAGGGAAGAAGACACTGAGATGGATAAGAAGATCCGCAGTTTTGTGAATAGCATTTTGAAAAATG
CTTCTGTCCCTGATGCTGATAAAGATGTCCCAACATCTTCCACCCCAAATGCTGAAGTCCTCTCTTCATCCAGTAAAGAGAA
ATCAACAGAGGAAGAGGATCAAGCCACAGAGGAGACCCCTGCACCAAGGGCACCAGAACCTGCTCCAGGTGACTTCATTG
ACCTAGAAGAAGTAGAATCTGATGAGGAACCCATTGCCAAAAAGTTGGCACCTGGCATTGCAGAAAGATTACAAAGCAGA
AAGGGAAAAACCCCCATTACTAGGTCTGGACGAATCAAAACTACTGCACAGAAGAAGAGCACACCAATCACTCCTACCAC
ATCCAGATGGAGCAAAGTTGCAATCCCTTCCAAGAAGAGGAAAGAAATTTCCTCATCTGATTCTGATGATGATGTCGAACT
AGATGTTCCCGACATCAAGAGAGCCAAGAAATCAGGGAAAAAGGTGCCTGGAAATGTCCCTGATGCCCCATTGGACAACA
TTTCATTCCACTCCATTGGCAATGTTGAAAGGTGGAAATTTGTATATCAACGCAGACTTGCTTTAGAAAGAGAACTGGGAAG
AGATGCCTTGGATTGCAAGGAGATCATGGACCTCATCAAGGCTGCTGGACTGCTGAAAACTGTCACCAAGTTGGGAGATTG
TTATGAAAGTCTAGTCAGGGAATTCATTGTCAACATTCCCTCTGACATAACAAACAGAAAGAGTGATGAGTATCAGAAAGT
GTTTGTCAGAGGAAAATGTATTAGATTCTCCCCTGCTGTAATCAACAAGTACCTGGGCAGACCAACTGAAGGAGTGGTGGA
TATTGCTGTTTCTGAGCATCAAATTGCCAAGGAAATCACTGCCAAGCAAGTCCAGCATTGGCCAAAGAAAGGGAAGCTGTC
TGCAGGGAAGCTAAGTGTGAAGTATGCAATCCTACATAGGATTGGCACTGCCAACTGGGTACCCACCAATCATACTTCCAT
TGTTGCCACAGGTTTGGGTAAATTTCTGTATGCTGTTGGAACCAAGTCCAAATTTAATTTTGGAAACTATATTTTTGATCAAA
CTATTAAGCATTCAGAATCTTTTGCTGTCAAATTACCCATTGCCTTCCCAACTGTATTGTGTGGCATTATGTTGAGTCAACAT
CCCAATATTTTAAACAACATTGACTCTGTGAAGAAGAGAGAATCTCCTCTATCCCTGCATTACAAACTATTTGAGGGGACAC
ATGTCCCAGACATTGTCTCGACATTAGGGAAAGCTGCTGCTTCAGGTGCTGTGTCCAAGGATGATTTGATTGCTGAACTCAA
GGACACATGCAAGGTGCTGGAGGCAACCATCAAAGCCAACACAGAGAAGAAAATGGAGCTGGAACGCCTGGTCAAAAGA
CTCTCAGACAATGGCGTTGATGATGGAGAAGCAGCTGAGGAAGAAGAAGATGCAGCAGAGGATACAGAATCAGATGATGA
TGATTCTGATGCCACCCCATGACTAGCTATTGGGGCATGTCCCTTTGAACAATTGATTGTTATTGGTCTGTAATATTTGCACA
TTAATTTCATGCCTTCTACTTTTGCCAAATTCTGTCTAAAAAGGGGAGTAGTAGGATATTATGCATGATTTATGAAGGATA
TTATGCATGATTTATGATTTTGAGGGGAGTAGTATTTATACTGCTGCTGCTGATGATGATTGATGTAAGCTACTGAAACTA
GTAGCTGATAGAAGATGCTGCAGTGAACTGCTGCCTAGCAGAATATTCACTTCACAGCAGTAAGAGCATGGAGACAGGGG
GAGCAGAAAGCTGATGTCACGTGAGATGTCTTGACATCCTGGAAAAGACTTGTAGATTTGCAACTTGCAGAATTTTGCTGTC
ACCACTACAGATACTGCTGTGCTTGATTACTCTGATAATGAAAGTTGCTGATCCCACTTGCATGACTGCTCGTACCTGCTCA
GGAAGTGTCTAAGTATGTTTTAGACAAAATTTGCCAAAGGGGAGATTGTTAGTGCTTAGCTTTACTTAGTTTTAAAAGATT
GGCTAAAATTTTGTTAAAACATAAAGCACTTAGACAATGAAGGAAAGCTGGAGTTGCTGCACATGATGTCTAACATTATGT
```

-continued

```
CAAGGAATCAGATTGGGGTGCACAATGCACAAGGCAAGATAAAATGTCAAATGAAGAATTGAAGCTGCAGGATCCACGAT
GTCGGATACAATGTCCAGGACATCCTGCCCGAAAATACTGGACACATAAATCTGTTATATCTTTAACAGATTAATGTGCAGT
CAGCAACAGATTAGGAGCTCTATCTTTAGGAACGAATTAAAAGATAATTAAAGATTGAATTACAAACTTGAATAGTTTCGTT
CAGGGATTAGAGATTGAAGATAAAAACTAAAAGATAAAACTTTATCTTTTAGATCTTTAAGTGCAGATTTTTCAGGAGAATG
ATAGAGCTTATCCAGCGGAAGTTGTTGCAGCCCAGATACGTACACTGCTATATAAACATGAAGGCTGCACGGGTTTTTATC
AAGTCAGAGATTGAAGAGTTATTTTGTGAGTTTTGTGACTTGAGTGTTTTGTGAGCCACCTTGATGTTACCCTAACATCAAGT
GTTGGACCTGAGTGTGTAGAGTTGATCTCTATTGTTCAGAGAGCAATCTCTGGTGTGTCTTTGATTTGTTTGTAAACACGGGT
GAGTGATTGAGAGGGAGTGAGAGGGGTTCTCATATCTAAGAGTGGCTCTTAGGTAGAAGTTGCATGGGTAGTGGTTAGGTG
AGAAGGTTGTATACAGTGGCTGTTAGATCTTCGAACTAATACTATTTTAGTGGATTTCCTCCCTGGCTTGGTAGCCCCCAGA
TGTAGGTGACGTTGCACCGAACTGGGTTAACAATTCTCTTGTGTTATTTACTTGTTTAATCTGTTCATACTGTCATATACAAT
CTGCATGTTCTGAAGCGCGATGTCGTGACATCCTGTACGACATCTGTCCTCAGTATCAGAATTTCAGCTTTGACTAATTCAG
AATAGACAGGTAATTTCAGAGACATGAATGGAATAAGATTGGAGTTTTCAAATGCTTGGAAGCATTCAAAATTCTCATTTGA
GAAGAACTCCATATCTATGAATTTTGGGTCTACAATGGAACGAGAGGAAAAGAGGTTTGTGTACCGTATACGCTGTTCCTCT
GATGAGAATAATGATCCAGAGGGAATGGAGGGAGGAATTGGTGCTTCTTGTGACCCGGAATGCAGCTGACTCCGACTCGAA
GTTCCTTTTCTCTTTTTCGATGGTTCTGCCATTTGAAGAGTTTTTTTGGGATTTCAATCGGTTCAAATGAAAGAGATTGAAAA
AAGATGAAGTTTGGGCTTTGTGGGGAGTGATTTGGATAAGAATTGAGTGAGATATGGCTGGAAGAAAAATTGGGGCGAGG
GTTTTCGAGAGAATGAAAAGTTGCAGGTTTCAGAATTTGAAATTTGAATAAATAGGTGCAGGGACGCATCGTAATCGATTA
CACACAATATGGTAATCGATTACCAGAGAGCAACTTTGCCAGAAATAACTGCTTGTAATCGATTACACTATTATGGTAATCG
ATTACCAGTGGTTATTTTAGCCAGAAAACAAAAATAGAAGGCTTTCTAGGAGAGAAGAAGTTTTGAAAACTATTTTTGAAA
ATACTATATTTGAAAATACTTTATGACTAATTTTCACTCATGTAATTTACATATCACGTCATGCAAAAATATTTAAAACATGA
AGATAATCAATTTTATCAAGAACAATTACAACACAAGTATGAAGAATATTGATTTTACTTAAATAAATGAATGAATATTTCA
TGCAAATAGAATGAAATCAATCAAGCAAATATACTCATGATTTCAATCAATCAAAAGACAAACAAATAAAGAATTTTTAGT
CATCATAGTCAATTTGTTTGAATAAAAATTTCAACTTTAAGAGAAATTTTAATAAGATAATGGTTTTGATATTACCTTTTTCA
GAATTGAAGAGTCTAGATCTTCAAAGATGAGGATCATGCTTTTTATCCTTGAGAGAAGTTCTTGTCACTTTCATAATCTTTAG
TTAGAAGATTAATCTCCTTTTCTGAACCATCAGATGAATCATTGTCATCCCATGCAATGTATGCTTTCTTAGTTCTTCTTTCG
TCAAATCTTTTCTTTTCACTTTTCTCCGACCATTCTTCATTTGACGGACAGTTGGCCTTGATGTGACCAATTTGGTTGCATTTG
TAACACCTAAGGACTTGAGAATCCTCTTGTGATTTTCTTCCATTATTGAAATTCTGACGCCTATCAATTCTTCTTTTCTTGAT
GTATTTCTGAAATTTCTTAACAAAGAAGGAAAAATCTTCATCATCAGAATCTTCTTCTTCGTTTTCTTCTTGTATTGAAGATG
AGGCTTTAAGGGCTATGCTTCTCTTCTTTTTGTCATTTTCTTCATTCTGATTGAGGCGTTGAAGTTCCATCTCGTGTTCCTGCA
ATTTACCAAATAAAGTGGCAAGAGACATGGAAGAGAGATCTTTGCTTTCAGAAATAGCAGTTACCTTGGGCTGCCATTCCC
TACTTAAACATCTTAAGACTTTATTAATTAAATCCTCATTAGGAAAAACTTTTCCTAATGATGCAAGATGATTTACAATATGT
GTAAACCTTTTTTGTAAATTCTGAATGTTTTCATTTGGATTCATCCTAAATAACTCATATTCATGGGTAAGAGTATTTATTCT
AGAACTTTTTACATCTGTGGTTCCTTCATGGGTTAACTGGAGAGTATCCCACATATCCTTGGCATTAGTACAATTTGACACTC
TAAAGTACTCATCTATCCCTAGGGCTGAAGTGATGATATTTTTGGCTTTGAGATCGTACTGGATTTTTCTCCTATCTTCTTCT
GTCCACTGATCTCTAGGTTTTTGGGTTGAAGTACTTGTGCTTACATCTACTATAGTGGGTATATGTGGTCCTAATTCTATTGC
TTCCCATATATTTAGATCTATGGCTTCAATGAATATTTGCATGCGGGTTTTCCAATAATGGTAACCCTCACCATTGAAAATG
GGTGGTCTGTGAATAGAATTTCCTTCAGGAAACAAGGGATTTGAGGAGGCCATCCTACAAGAAACCTGCTCTGATACCACT
TGTTGGATCGAGTGGCCTCAGAATAATTAAGAAGGGGGGGGGGTTGAATTAATTATTCCAAAAACTTTACCAATTAAAAA
TTACTCTTTTAAGGCTTTTACTTTTGTTGTTAAGAGAATATGGAGTAGAAGAGAAACTTAACAGAAAGTAAAAGCGAAAATT
AAATGCACAGTGGAAAGTAAAAGAGTATGGAAGAAGGAAACAAACACACAAGAGTTTTTATACTGGTTCGGCAACAACCC
```

-continued

```
GTGCCTACCTCCAGTCCCCAAGCGACCTGCGGTCCTTGAGATTTCTTTCAACCTTGTAAAAATCCTTTTACAAGCAAAGATC
CACAAGGGATGTACCCTCCCTTGTTCTCTTTGAAACCTTAGTGGATGTACCCTCCACTAGAACTGATCCACAAGAGATGTAC
CCTATCTTGTTCTCAGTCAAACCCAAGTAGATGTACCCTCTACTTGTACCACAAAGGATGTACCCTCCAATGTGTTAAGACA
AAGATCTCAGGCTTTTAAACCTTTAATACTTTGTGAATGGGGATACAAAAGAATTCTCAGGCGGTTAAACCTTTGAACGCTT
TTGTATTAGGGAATGGGAAGAATCAAAAGAATTCTCAGACTGTGTCGTTTTGAATTCTTTGACAAGGGAGAAGGGAGACAC
AAAAGAATTCAAGCGGTTAGTCCTTTGTTCTTTTGGAAAAGGGAGAAGAGAGACACAAAAAGAATTCAGGCGGTTAGTCCT
TGGCAAATGGCAAAGGGAGAAGAGAATGAAAAGGATGAATAGCACAAGTTTTCAAGGTTTAGAAAACCAGAAAACTTCAG
AAAGCTTTTGGTACAAAGAAGAAGAAGAAGTTCAAAGAGATTCAAAGAGATTCAAGGCTTGTAAAGGATTGTATGAATAAT
TGTTCAAGATTGTTGTTGGAAAGATTGATTCGGAATGCAAAACAAAGTCTTGCTTTTATAAACTCTTGATGTCTGGTCAAGA
AGGCCATTCAGAAGAGTTATAACTTTTTAGAAAAACTTAAAACCCATTTGAAAAGTCAAAACCTTTTTGAAGAGTTACATC
TTTAGATTTTTAAAAAACAAACACTGGTAATCGATTACCAAATATGTGTAATCGATTACACAAAGCTTTTGAGTGAAACAAT
GTGACTCTTCACTTTTAAATTTGAATTTCAACGTTCAAGGACACTGGTAATCGATTACCAAAACATTGTAATCGATTACAGC
CTTTTGAAAATATTTGGAACGTTGTAAATTCAGTTTGAAAACTTTTTCAAACTCATTTTGCTACTGGTAATCGATTACAACAA
TATGGTAATCGATTACCAGAGAGTAAAAACTCTTTGGTAAAGGTTTTGTCAAAAACTCATGTGTTGTTCAAAGTTTTGAAAA
ACTTTTTAATACTTATCTTGATTGAGTCCTTTCTTTATTCTTGAATCTTGAGTCTTGAATCTTGAGTCTTGAATCTTGATCTTG
ATTCTTGAGATCTTGAATCTTGATTCTTGATTGTAGGCTTTCTTCTTGAGTCTTGAATTCTTCTTGATTCTTGAACTCTTGACT
TGTTCTTGATTCACTTGAGATGTTCTTTGATTCACTTGAGTTTTTCTTTGATCTTTTGAACTTTTTGTTCATCACCATTGTCATC
ATCTTTTGTTGTCATCATTGTTATCATCAAAACACCTTTGAATCATTGTTGATTCATCATGAAGCTTTGCTTCCACAGATGGT
GGTTTAGGCTTGAAAAAAAAGCTTTGTCAAAAGTGTTGGTGTACAACAATCTATGCACAAGGATCTCGTTAAACTCATCTGG
GAGATAAGAAATTTGTTTTTTCATGAAAATTTTCAAATATGTTAACAATTGTTGATGGTTGATTTTAAAGATTAAGATTTTTC
ACGAAATTCTTTAGATCTGTTCTATTACTTGATTCAATTGAAAATTGTTTAATTGTATCGTATTATTTTATTATATGATTTTTG
TTGTTGTATTTGTTGTCTTTGGATATGTAAATACATCTTCATTATATTTCTCACCGGAAAGAGATAAAGATAGAAAGGCTAA
AAAGAAAAACAAATAACAAAAAAATCTTGATTGTTAGATTAAAAATAAAATAATCTATTTTTAAAAAAAAGGAAGCGATC
TTGGACGGTTGAGATAAGAGAAACTTGCAAACACATTGAGTAATAGATATATCCAAAGGCCAAAAAATAGTTACACATGTT
GCAGGACCTATCGGACTTTACCACACTAGAAGGCGTCATAACCTATATCAAGTGTCGCAACCTACCCTTCGACGGGACGG
CGAGGCGAAAAGCCAAAGTTGCGTCTTCTCATGAAGAAAGCGCGTAGAGTCGCCACCAACGTTTATTCAAGGAAAACATTA
GAAAAAACCAAAAGAGGTCTGCGGATTTTGAAAATAAGGGTTCGGGAGTTGTTTACACACGGGGAAGGTATTAGCACCCC
ACACGCCCGTCACAAGAGACGACAGCCTTTAATCGAATGTGCAAAAATGTGACTTCAAAATTATGTGAGGACTTTGAGTCC
TATGAAAGATAAAAGTGAGGACTTTGAGTCTTGTGAAAGATAAAAGCGAGGAATTTCAATCCTGGGAAAAATAAAGGCAA
GGACTTTGAGTCCTCTAAAAGATAAAGGCGAGGATCTTAAGTCCTCTAAAAGATAAAGGTGAGGACTTTGAATCCTCTAAA
ACAAGCCAATAAGCACTAGTACCAATGGGCTCAACCTTAAGAGAAAGCAAGAGATCGACTTTTTGAGAGGGCCTCTCATCC
TTAACTTAAAAAATTAGATTTGGTAAAGTGGTATATAAAGAGAAATCTACGCACTTATAGCCTAATATGAACATGATTTTGG
GATGCAGATGCATGCAACCTTCATCTTGAAATGCTAATAATGCAAAAGGTTTTGAATCATGAAAATTGTGTAATGCTCATGA
CATTCTTTCCTATTTTTGTGATTTTGATTTTGATTTGATTTTTTTTTGTGGAAAACACATATTGACTGTCTCTTTCTAGAAGA
CATGATAATTCATGCAACCTTATTTTTTTTTTTTGCAAATCTCTTCGATGACTCCCTTAGAGTGTATGTTTTTGTTTGATCA
CTTGAAAATTTTGGAGTGACGGCAATGGAGCTGTTTTACATTTAATCAATCAACCGAAACATTGATCCTAGGGTTTGTCCCT
TTCTTTTTTGTTTAAAACCTTCTATTGTTCTGCACAGCAAGAAAACATAAGGCTTTGGGATCGATTGTGCACCACACTGAAG
GATGGCAATGAATTGTCACACTTTGGTATGTGACCAAGTGAAACTTTCCTGATTTAAGGTCATAGAGTGATGCCAAGGGTTT
GTCGATTCCACTGAAACTTGATGAAATGGGCTAATCCCGAAAGAATTTATACCACAAAGGCCACCCTGGATTCAAAAGGAA
TTCTAAGGAGTCTGCATGAGCAACTAATATCAGATGTACCCTACTATCACAATTGTCTTTGGGAATTTTCCATGAGCTCCTG
```

-continued

```
GTCGAATGAGTTTTCTTCTCAGATGTACCCTACTATCACAATTGTCTTTGGGAATTTTCCATGAGCTCCTGGTCGAATGAGTT
TTCTTCTCAAATGTGCAAGTACAAAACCTCGAGGATTCTTTTTGTTTTGTTTATATATATATTTTTTAACAATCACAAGCGT
GTGTAGGTTTCATTCTAGAATCCCAACTTAAAAGAAAAATTAGTCATTCCTTGATCCACATGGGCTTTACTGGGCTTGTAAC
GTGGTCAGGGGTAAGAAGACTATGAAAGAAAGGATTTAGAGAGGCTTAAAGAGTGTTTAAGGGTTACATTGAGTAAGAACC
TCAAGAGCATTGCTTATACCTTTTGGGTTGAGCTCTACTCCTTTTGTCTTATACAGTAATCTTTATTGCACTTTTGTGCCTTTC
TTGTAAGATTTGGAGATCTTTTGTCTCTTTTTTTTCTTCACTCGCCTTTGGCGGACTTTATCTCTCTTTTTTTATTATTGTTTC
CCAACTTCATGCATGTGTTGTTTGCATTGCTCTTCCCACCAGTTTAGCAGTGGTTCCTACTCAGAGTTCCTATTTTGTTTTTGT
TGTTTTTCGAAAACAAATATGCTTTGGTTCGGAGAGGGTAGCAAGGGATAAATTAGTGTTTGGGATGTTGAAACATGGCAT
GTGTCATTTCAAATCTTGACTAGATACTTTTGTAGTTTGGATTTTGAGACAAAACCTTAATAACACGCCCCTAATTGTTTGTT
TTTTTTCTTTTTTATTATTACCCTAACTTTTGCCTAGGTCACCCTTTCAGGTTCTGAACCTATCGGGTAAGAACTTCTGATCTG
CCCCTAAGTTTGCTTGAGGCTCATGCATGGTGCCTCTCATTGCCCCAATGTAGGGCTCTGAGGTATCTATTGTTGCCTTTTGT
CATGACCTTGTAGCAAGGAAAAAAAGAAAGAAACTATGCAGGTTCTCAAAAATGAATTCCGAAGGATGAGAAATGTTTAA
AGGATTTTCAATTGACAGATTAAGTCGAACGACTCTTGTTCTTGATAATTCACTTTTCTCTCAAAAAGAAAACTTTTAAGAA
TGATAAAATAAGGTCACATGAATGTTTTTACTTCTTATTTTTTATTTGAAACACGATTAATCAAACGTTTTTTTTTTACTTTAC
TCGTCGTTTACGGCACCCTCACCAAACGTGTAGAACGAGCAATTTCTGATTGAACAGACTTGGAGATCAACTCAGAAGTGC
AGGTTGCTTGAGCCAACAAACCAATGGCTTACATTCACATTCCAGTGAAAGTAAAATAAGCAAAGACGTAATTGCGAGAGA
ATGAGAGACAAGGACATCAAATTTATCCATATTATTAGCATTGTGACTATTGTTTATAATAATGCCATAAACTTAAAAATCC
TAATGAGTCATTGGAGACATCTAACAACAACCTTCAAATTGCCCCATGCATAGTGTAGCTTGACAACGTTAGAATTCGTAA
GCGATTGTCCTCCTCGAATTTCAATTAGACTTTGCACCTTACGTTTCAGGGTCATACAATGCTCAATGGAATTCCCAGGAAC
TCCTCCATGATAAGCACATTTTGCATTCAAGTTGTATCCTCGGGAAAATGGAGGTTGAGGAATCTTTGTTGGGATTATGACT
ACCATTGCATTATTAAGTAGATATGGGAGCAAATTAGCATACGACACGGGAATTGGGGTGAATTCTACAGGCTTCTTTTCTA
GAAAATTCCTTCCTTGGTTAGTGTTTTGGTTTGTGTTAAGGGTGGTGTTTGATATCGGATGTGCGACAGGAGGGCTTTGCGG
CTGATTTAGGGGTGGCCTTTGTGGATGATTGGGTGTTCTTGACTGGTAGGGTGGTGGGCAATGAGAAGGACTGATATTGGCT
GAGTGTTGACATTGTTAAGTTGGCGAGAAATTTGGCCATGTAGGGACAACAGTCATAGCACGGGTTCTTCCCTCCTTCTTAT
TCTCTCCATTTTCCCCAAGCTTCATATTCATCCAAGTAGGATAATTAAATTTTCCTCTTCTTAGATCCACTTTGATCCTTTCGC
TGGCGAAAACCAAATCAACAAAGCTTGAAGGCATGTAACCCACCATCTTCTCATAGTAGAACATCGGTAACATGTCTACTA
TCATTGTTATCATCTTCCTCTCCATCATTGGGGCGCTACTTGAGTTGCCATATCCCTCCACCTTTGGGCGTATTCTTTGAAA
GATTCATGCTCCTTCTTGCACATGTTCTGTAGCTGCATTCTATCCGGAGCCATATCAGAATTGTATTGATACTGCCTAATGAA
GGCAACCATTAGGTCCTTCCAAGAATGGACTCGGGAAGGTTCCAAATTGGTATACTAGGTGACGACTATCTCAGTAAGACT
TTCCTGAAAGAAATGCATCAATAATTTTTCATCTTTCGCGTATGCCCCCCATTTTCCTGCAATATATCTTCAAGTGATTCTTG
GGGCAAGTAGTCCCCTTGTACTTATCGAAATCTGACACCTTGAACTTCGGAGGGATGACGACGTTAGGCACTAGGTACAAC
TCTGCCATGTTAGCAAAAGCATGATCTCCGCCTCCTTCAATAGCCCTCAGTCTTTCCTCTCTCTGATTGAATTTTTCCCTTTC
CACCATAGCAGGAGGGACTCTTCCCACCGCAAAATGCAAGGGTTGTGGTTGTGGGAAAAACTAAGGGCCCCCAAAGTGTTT
GGCAGGGGTACACCACTAACTGCTTGCCCTTCAGTGGCATATCGGAGGTGAGGTTCGAAGTCGATTATATTATGGTCTCGG
GGTGCTTCATGTGTCTCCTCCATGGGTTGAGAGACATGTGCATGATCAGATTGGGGTTTTTGGCTCTCAATGGGTATGGGGG
CATGAAGTTGTCGACATTCTCATCGTGAGTGTGTGCAACATTGGGTGGTGCGTAGTTGGGAGGCAAGCCAGGGAATGAATG
CTTGCTCTAAACTTGCACAAAATGGTGACTGGAGGATTTACTTGATTGAGGCTCGATAAGTAAGTCAGGTCTACCTCAGTGG
TGACACTCGTAGTGGCAACTGCAACCGCATTGCTTTCCATTATTTTCTTCATGCTCAACATGGCCTCCATCATGGCGGCCAT
TTGGTCTTTCATGGCCTCCATGTCGGCCTTCATCTGTTCTTGCACTTCTTCTATTTCACTCATTATTCTAGCTCAGGCACGCGT
TCGGTAAGGGCGCCATAAAAGTGCATTCTTTCCTTTTGATTACAATGATTACAGTTTTGATTTCAAGGAAATAATGAAATGA
```

-continued

```
GCAATGCAACCAACGTGAAAAGAAAAAATAAGCATGGATGTATGTGAACAAATACATTGTTGAAGTATTGCAAATTTACAT
AGGGCACTCAATAGGGTCGAACCAATTTAGATTTTCATTAAAACAACATTGTTCATTACATTTTGTCAAAATGCAATAGGAA
ATAACGCATGGACATCAACAATCCCTAATTTTTGTTAATTATTTAGCTCAACCATGTGTTGGCAGTAGACAAAGAAGCTATG
TAAACTTGATCCATCTTCTGCCCCAACTTTTGCAAGCTAGTTATTTCCATACTTGACTTTGACTTGATGAAACCTTTTTCTTA
AAAGCATGTGCTTGGTTCGACCCCATAATCCAAGGAATAGAAATTTTGACTGTCAATACTTCAACAACATATCATAGAGAT
GAATGACTTGGGCATACTTATGCTATGCATGACACATGTAATTATGAGGTTGACATGAGATGCTTGAAGAAACATCATTTCC
AAGTTAACCATGCATTAGGTACCATGTTCACATGATTTTCAATAATTTTTTAAGAGAAATGAGTGCATAATCCCAACATGGT
TGGTTTATAGCTATCATCATAGTACCCAACACATGTAACTAAGAATGTGGTGTAAACTTTCACACTTTATGGTGACTTTCTTT
TGTTCTTTCTTTCTTTATTTTTAATTTTTTTTTTTTTGCAGAGGAAAATGCAAGGATCATGCATGCAAACTATGAAAATAGAA
TGTATGCAGTTGGCAGAACAAAAGCATGCTAAATGAAAATGCATGACAATGCAACAACTTATGCAAATGCAATGCATGGAT
ATGACAAATGATAAATGCAAGAATGATATGTACATTATGATGCCATGAAGAGATGCATGATGCGATCAAAGAACAAGCCA
GAGTGAGTTTTCTATGTGCCACCCTAATTTAGGAACCTAATGGAAAGGATCCAAAAGTCCCCTTCTAGTCACAACTTCCAAG
GATGGTTTCATGTAACTTTACCGGTCTCTAGAGATATCATCCTGTTAGATAATACATTGTGGCGATAGGGACTATCAGCGAC
AATGCATCACCAAAAGAGGAAAACTCTAGATAAGGCTTCACTGTTACCAAGCGAGTCAGAGACCCAGCATGAACACAGAT
TGACCTCCACTCCTTATGGCTCACATAGACCCGGGTATAGGGCCTAATATCTCAACGTGTGTGCGAGGCGTAGGTGCCATG
TGTGCGTAGAAAAAAATATTTCTAACTATGAATGTAATTGATAGACAAACACACACCAAACACAACAACATAGCAAAGATT
ATATACAAATATGGACAAAACAAAAGATAAAAGGGAAAAGGGAACATAAATAAAGAAGAAGTCACGATAAAAACATTGC
ACACTGGCTGAATGACCTAACTCTCTAACAGTCCCCAGTGGAATTGCCAACTGTCACAACCAACCCTTTGGCGAAAGGGCG
AGGCGAAAAGCCAAAGGTGCGTCTTCTCATGAAGAAAACACGTGAAGTCGCCACCAACATTTATTCGAGGAAAACGTTAG
AAAAAACCAAAAAGAGGTATACGGATTTTGAAAATATGGGTTCGGGAGTTGTTTACGCACGAGGAAGGTATTAGCACCCCA
CGCATCCGTCACAAGGGACGGCAGCCTTTAATCGAATGTGCAAAAATGTGACTTCAAAATTATGTATTTTCCCTTTTTATAT
TTTTTATTTTTTGGGGTCGACAAGGGTGTTGCCCTTGCTTCTACGTATCCTCAGGTGCGATGAGGAATTTAAACCTACATAGT
TCTTTAAGTCTGAAAGTTTGTGTGTTACATTAATTTTATGCTTTTTAAAAGATCGATTTTAATTGCGAACAAAAGTCGTTTAA
GGCATTGGACCTTGAAACGATGTTTTAAAAATTTGAAAAGCGGAGAGAATGGTTAAGGCGTTGGACCTTGAAACGACCTCA
AGTGATGTTTGATGAAAAGCAGAGAGAATCGTTAAGGCATTGGACCTTGAAACGATCTCAAGCGATATTTGATTAAATGAA
GAAGTTTATGAGTTGGTTTTATTTTGGTTTTGCTTATTAACCTTCAATCTTTTTTAAAGATAACTTGTAAGGGTGCACAAAAC
AAGAAAGAGGATGAAGATGAGATTATTGATGATAAAAGAAGGAGATGAAGATGCACAAAACAAGAAAGAGGACTCGTAA
GGGTGCGTAGATCGCATTCAAATCCTTAAAACAAAAACTAACCGGATGACAAACGAATAACAAACGAAGAACAATGTAGA
AGTCGATTAGGATCGCAATTCGGTAGCACCTCGGCCTCGTTTTTCTCTTCTTTCTTCTTCTTCTCTCTGATTTCTCTCAATGTT
GGACCTTGGAACCCTTTACTCAGCCTCCCTCACACCTATTTATAGCAAAAGATGGCATTAGGAGTCATGGCAGCTCACCCA
GGCGAGTTATAGCTTCAACCTGAAGTAACTTTGCTTGCCCAGGCGAGCTAGTTATTTCACCCCTAAGCTATTTTGGGGCCTA
AGCGAGCCAGGGGCTAGCCTGGGTTCAGAAAAAGGCTTAAAATGACCCTGTTGCCCTCTTTTTTTGGGTATTTTCTGTATTC
CTTATGGAAACATCAAATGATCTTTCATCTTGCACGGTAACTGGTGTCATACAGCTTAATTCGGCTAGCGAGGATCAAAAGA
TCAACAAATGATAGTCTTAGAACGAAATTAGGGTATGACACAAAGTTATTAAACTAACACTCGTAGTCTTTATTGTCTAAGC
CTTTCTACGCCCCAGGAATCTGGTGGGACTAAAGCGCTTAAGATTAACAATGTTGGAATGTCCATCAATAACAAGCTCAGC
AACAACTCCAGTGGCAGGACCATTAAGAATATTATCCCAATTATGCCCTGTTGCAACATAACACCCCTTCACCCCTGGAAC
CTCTCCTATTACTCTCCCTTCACACATGCCACTCCTTCCCTAAGATGGCTTGAAACAGTCTTCACCACCTTTTTAAGCATCAC
AATTAATTCAGGGTTTCCCTTTATCTCCTCACGATTATCCGAAACTTCTTTCTCCTTCGACATCCCACATATATAAACCTCCC
CTGAAAATAAATGTTTACATTATTAACCTCTTTATTAATATTATTATTACTAAGTGTGACTAATTACTACACCTGGGAATCAA
CAAGTTGCGTTTGTCCGAATGATACTAGATTCTGTTTGGAAGGGAAGAACTCATTAAAAGTGACCAGTTAAATTCTCTAATA
```

-continued

```
AAAATTAATGATTGGTAAAGTCGGTAGATGTTCTGTAAAAAAATAAAATTAACATACCTGTGTGGGGAGGGTACACTTCGG

GGTCAAGAGATTTTCCTCGTTTAGAAGAATAGTAACTGAGAAAGAGGGCATGCAGGGTTATAGAACCGGGCTCTCTGGCCT

CTAATACAATGCTATGGGCCTTAAGCCCATAAGCCCATAAACTATGAACAACAAAACCAACTTACTGGACTAAGGGCCCAA

TGTTAACACCATAGAATCCGCTTCCAAAACTCGTCCTTCTTCAAGCACCATCGATCCAACTCATCCTTCTTCCACTTCCAAC

CGTTCCTATTTTGTAATCTCTATCTTCACTCCATGCTTCTCCACTGATCTATCAATCAGCGCGGGAATGAAGAGCCATAGGT

GCACCTGCACTGTCATTTCGATGGTTCCAACCACGAGTAGGTCTGTCAACTCAAGACGACAACATTGAGGTGGCAGAAAAG

GAGCCTTCAAATTCCGTAACGATGAGGCTGAGAGTGGTGAGGGTTCTGTAACTGTACGATCATGAACCGTCTAGTTCTTCGA

AGAGTGAACGGTGGAGGTTGAAGCTCATGTGAGCTAGCTCTTCTAGCGGTCCTCTATTGCACCAATTGAGGGCAAGGAATC

TGCCAGCTTTTTCGAATGCAGTGCATGCCACGTTGAATTTCTCAATGAGCATGATATAGACACCCTTCACCGCCAGAAAGTA

GGCGGTGCAGACTTCGATGACTCCATCGCCGCAAACAACCACTTGCTTCGAATGATCCATGGACAGTGAATCAATCAACTT

TGCTGTCAAGATGTGAATTCTGTTTTGCCAAAATGCAATTAGTGGTGGCCACACCCCACCACTTGATTCATTATTCATACTC

ATCCAAAATCTTTTTTCTTTTATTTTTTATTTTTAATCAAGCACATGTTTGTTAGTATGTTTGTTCACGTTCCGACATTGGCAA

AAACTTCTACTATTTGATGGACTATTTGGGCCCTTCTGATAAAAGAAGTGCATATCCAATATTAGCGAACTACTATAGGCAC

CACCTACTTTTTCTAATGGCACTAACCGTGAGGGTGCTTTTTGTCCATATTTCAAAACTGTCCCCTTAAAAATTACATAATAG

AAACGTGCTTCCATTGTGCAATTGGGGTGAAAAAAATGTACAACAAAAGTACACTTTCTTTGTGTATTTTTCCCCCTAATTG

CATAACAAAAACATGTTTTCGTTGCACATGGATAGTTACACAATGGAAATGTGTTTTCTTTGTCTAGACATACAACAAAAAT

GTGTTTTTGTTTTGTTAGAAAGCATAAAAAATTACACAATGAAAACATGTTTCATTTGCACATGGGTAGTGTCGCAACCTAC

CCTTCGGCGGGAGGGCGACGCGGGGCTCACAGGTGCGTTTTTCAAGAAAGGAAAATGCACGGAGTTGCCACCAACATTTAT

TTGAGGAAAACATCGGAAAAACCGAAAAAGGTGTGGTCTACGAACTTTAATCGTGAAAGGTTCGAGAGTTGTTTTTATGCA

CGGGGAAGGTATTAGCACCCCACGCGTCCGTCACAAGGGACGACAACCTTTAACCAAGTGTGCAATATCATGTCTTCGATT

TGTTTTATTTTCCCTTTTTATGTTTTTATGTCTTTTTTATGCTTTTTGTATTTTTTTATCTTTTTGTGGTCGACAAGGGTGTTTC

CCTCGCTCCTACGTATCCTCAATTGCGATGAGGAAATCAGACCTACGTAGTTCTTTAGAACTAAACGTTGGTTAAGTTGTTT

TTATCTTTTTTCGCAAGATATATTTTAACCGAACAAAAGGTCATTTAAGGCGTTGGACCATTAAACGATCTTTTGATTTTGAA

AGGAGAGAAACGTTAAGGCATTGGACCATTAACGATCTCTTGGTTTTTGAAAGGAGAGAAACGTTAAGGCGTTGAACCATT

AACGATCTCTTGGTTTTGAAAGGAGAGAAACGTTAAGACGTTGGACCATTAACGATCTCTTGGGGTGGTCAACAAAAGCGG

GGCTTTTGCTCCTACGTATCCTCAATTGCGATGAGGAAATCAGACCTACGTAGTTCTTGCAAAAGCGGTAAAGTTATGTGTT

GATTTTATGCTTTAGAACGGTCCATGTTAACCGATAAAAGCAAAGATGATCGTTTAAGGCGTTGGACCTTAAAACGGTTTTG

AGTGACTTTTGCGGACGAAGCTTGATTTGTGAGTTGATTTTAGCCTTAATTTCACTTTGATTATTAGTCAATTCATTCAAGGA

AACTTCCAAAGAAAAACATCCGATTGATTTTTTTGATTATTTTATTCAAAGATATTTTGATTATTTTATTATTATTTTTCCCTT

TTTTTGTCTAACCGTGGTTACAGTGTGAACGATTGATTAGATTTTACTTTAATGGTGATTAATCGAGATTACAACTCAAATGA

TCGGTTGAAATTTATTTTATCATTTACTATGTGAGAAAACGGATTAAATAAACGGTTAAAGCACGATAAAAGGGGTACGG

AAAACAAACGAAATGAAAATAAAAGTACGCGAAACAAGTAGGGACCACTAAGGGTGCATAGAATGAATTGAGAGATTCAA

TTTCGGGAACTTATCGAATGAAGACCGAAGAACGATGAAGAACGAACGAAGAACGATGAAGAACGGTGAAGAATCTCCAC

GAAATCGCCTACGAAACGTCTCGGAAGTGTTACGGAAGCACCTCGGCTTGGATTTTTTCATGGAACAATTTTTCTCACTA

ATTTCGAGAGAATTCTCAAATACTAGAAGGGCTGAACCTTTTGTTTTGCCCTCTTTCCCCAATTTATAGGAGAAAAAGGGA

GGTGGTTGCCGCCCAGCTCACCCAGGCGAGCAGGGTTGTTTCCACTAGAAGGCACCACCTTCTTTTGGAACTCTCAGGAAG

GCCCAAGTGGGCATGGTTGCTATTTGCACCCCCTTTTTCACTAAACACACTCCCTTTTGTGTTTTTTATTGATTCCTTTCCG

AAACGTTACGGAACTTTACGGATTACGTAACAACACCCATTTTCATTTTGGAATGTTGCGAAACCTTACGGATTACGCAATG

ATGCTTGTTTTTTCCTTCCGGAATGTTGCGGAACTTTACGGATTGCACAGCAATACTTGTTTTGACTTCCAGAATGTTGCAA

AACTTTACGGATTGTGCAACAATACTTGTTTTGACTTCCAAAATGTTGCGAGACTTTACGGATTACACAACGATGGGTGTTA
```

-continued

```
AACATTTTGAGGCGGTCAAGAGAAGGTCGCATGCCAACAAATAATGGTCCCTGGACGAAATTAGGGTATGACAGTTGCCCC
TCTTTACTTATCTTTTATTGGAGATAAAAGCGAAGTAAAGATAAGACACTAATTTCGTTCGAGCAGAACATCATTCGGCCGA
TCAATATCCCAACCAGCGGAACCTGTCATTTAGAAAGAAAAGAAAAGGCACCAGAAGCGTTAGCAAAACTTCAGTGTCTTG
AAAGCGATAAAACAGGATAACCATGACGTTTCCACATGCTATCGAACTCGATCGTCCCTGCCTAGCAGTGAAGAATCTTGC
GCGTCGTCGGACTTGAATGTCTCTGGATGACGAAAGTAAAACCTGCAAAAATTTTCAAAAATAATCAGAACCGGACGACCA
CATCATCCCGATACCATCGAACTCGTTCACCTTGGTTGACGAAAGGTGCGGATAACCATAAGGTACCCCCGCATGTCATCG
GATTCGCCGTCTTTGGATGACAAAAGTAAAAACCTGCAAAAATTTCAAAAAATAATCAGAATCGGACAACCAACATCATCC
CGATACCATCGAACTCGTTCGCCTTGGTGGACGAAAGGTGCGGATAACCATAAGGTACCCCCGCATGTCATCGGACTCGCT
GTCTCTGGATGACAAAAAGTGCAGAAGACGATGTTAGTCTATGCGTGTCAACGGGCTCGCTTGCCTCTGGTTGACAAAAGG
TACAGAAGACGACGTTAGTCTCTGCGTGTCAACGGGCTCGCTTGCCCCTGGTTGACGAAAGGTACGGAACACAACGTTAGT
CTCTGTGCGTCAACGGACTCGTTTGCCCCTGGTTGACAAAAGGTGCGGATAACCATACGGTACCTCCGCATGTCATCGGAC
TCGCCATCAATGGATGACAAAAGGTGTGGATAACCATACAGTACCCCCGCATGTTATCGGACTCGCTGTCTCTGGATGACA
AAAGGTGCGGATAACCATACGGTACCCCCGCATGTCATCGGACTCACCATCTCTGGATGATAAAAGGTGCAGAAGACGAC
GTTAGTCTCTGCGCATCAACGGGCTCGCCTCCCCCTGGCTGACGAAAGGTGCAAAAGACGACGTTAGTCTCTGCGCGTCA
ATGGGCTCGTTTGCCCCTGGTTGACGAAAGGTGTAGATAACCATACGGTACCCCTGCGTGTCATCGGACTTGCCGTCTGTGG
ATGACAAAAGGTGCGGATAACCATACGGTACCCCCGCATGTCATCAGACTAGCCGTCTCTGGATGAAAAAGGTGCGGAT
AACCATACGATACCCTCGCATGTCATTGGACTCGCTATCTCTGGTTGACAAAAGGTGCAGAAGACGACGTTAGTCTCTGCG
CGTCAACGGGCTCGTTTGCCCCTGGTTGACGACAGGTGCTGATAACCATACGGATAATCGCTTGGGTATCTCCACATGTCAC
CGGACTCGCCGTCTCTGGATGACAAAAGGTGCAGAAGATGACGTTAGTCTCTGCGCGTCAACAGACTCATTCGCCCCTGGT
TGACGAAAGGTGCGGATAACCATACAGTACCCCCGCCTGCCACCTGACTTCCCGGGTCAGGGTTAACAGAAATCGTTTGTA
CGAATAACCGCTTGGGTATCTTCGCATGTCACCAGACTCGCCGTCTCTCGATGACAAAAGGTGCAGAAGACGACGTTAGTC
TCTACGTGTCAACGGGCTCGGTTGCCCCTGGTTGACAAAAGGTGCAGAAGAAGATGTTAGTCTCTGCATGCTACCGGACTC
TGAGTCTGACGGATAGCAAATGAATGTGTGCGGGTTACCGTATAGGGCATCTCCGCGCACCAACGGACTCACAGGTCACGA
TAGCAAAAGGTTGGGCGGTCGACAAAAGCGAGGCTTTTGCTCCTACGTATCCTCAATCACGATGAGGAATTCAGACCAACA
TAGTTCTTGCTTTTGTGATACTAAAATAGTCTCGGTGTTTTTTCACTAAAATGCAAACAGGCTTTAGTAAAGAAACAAAACC
TCCAACTGATCAGAGCAACATATGATTTTTGATGAAAAACAATGTGTCTAATGGGGAAGGAGAGTATGCTAATGAAATTTT
CTCATAACCATAAATGAGATTTTGGATGTTAGCATTTTGTTTCTAAACGACCATTTAGAGGAAACACTGGGTCCAACAAAA
TAGAAGAAAATCACTCAAAGTGTATCAATCTCACACAGGTAAGTGTTTCATCCTAATTCAGAACCATAGATATGTCATGACT
TGATTTTGCAAATCATTTCCTATCAAATCAAAGATTACATGTGTGATCACAGATCAATAGGACTTTTTCGGGAATGGTGTTTT
TTTTTTTGTGGGAAATTTGGCTCTGAGTGTTTTGGCCTTTTCCTTTTCTGTTTTTGTTTAGTGCGGGGCGAAAAAGTCACCGA
CGCACAGGATTTTGGTTGGCAATCAAACGGAGAGGACCACTTCAAGTCGTGGTTTCCTTTCTTTCCTTATTTGGCTGTGACT
ATTCCGTATTGTTTGGATATTTGTCTTGTCCGAAGACACTTCTGTATAATTCTTTCATTGTCTTTGATCGGAGATTTTCTCCTT
TTTTTTTCTCTTTGTTTTCTCACAATCTTTGATCAGGAATTTCTTTTTTTCTTTTGTTTTCTTTCGATCTTTGATCGGGAACTTTC
TTTGTTATGGAAGCATGTTAGCAACTCAATAGTGAATGACTTTTTTTCTTGGGAGACCCTATTGCTCCTTCTTCTGAGGACAG
GGATGGAAATTCTCATCCTGGGTCAAGGTTTATGGTGGTTTGAGGTCTTGGGTCAAAAGGCTTGTAGAACGGCCGGACATG
ATGTATGTCAGGGTGTTGGTTTGGCCAGCGGTTCAGGGATAAAGGAATGTCTCACATTATTTCCATGACACACATGCAACA
ATGATGATTTAGAAATTTTATGCAAAACTGGTCATATATGCACCCATGTGGACACTCAAGTATCAAGTTTTTATGGTCATGT
GACACTAGGGCCCAGGATTCATTTTCCCTATTTAAGTCAACCTAGTGTTTCCAAAACATGTTTTTTTATCAATTCATGCATC
CATTCGAGTCCATTTTGGGCGTTCAGAAAAATTTCACAGCATTCACCCTTCAGGTGTAGACACATTTTCCTCAAAAACCCTT
GTGTTTTGATTGGTGACTCTTTCCAAAGAAAAGCTGGAGACTATTTCTTTTCAAAAGCATGTTGGCTTTTTAGTTAACCAATT
```

-continued

```
ATTATTATTATTTTGTTTTTTTGTTTTTGTTTGTTTTTTCATGAGGTATTTTGCTACCTAAACATATGTATATTTTGTGAGGTA
TTTTTGCTATATACATATGTATCCAAGGTATCTTGCTACCTAAACATACATATATATATTTTGTGAGGTATTTTTGCTATAT
ACATGCATATCCAAGGTATCTTGCTACCTAAACATAGATATATATATATATTGTGAGGTATTTTTTTGCTACCTAAATTACAT
ACATGTATATCTAAGGTATTTTCGCTACCTAAACACACATACATATATTTTGTGAGGTATGACTACCTTCCGAGCTTGTGCTT
GTTTTATTTAAATTCCTAGGATCATGAGCAACTAGGTGTGTCCTACTATGACTTGAGAAACAAAGGTGATCAAATAACAAGC
AGAGATTTAAAAAGTACTAGGTTGCCTCCTAGTAGCGCTTCTTTAACGTCTTGAGCTGGACGTGTGATGACTTGTCGATCAC
AGACCTAGTACTTTTGCTTACCTTTGGCTTTGGAATTGGTCGCCTGCTGGTCGGTCATGGGTCGTAGGCAACGCTCCAGCCT
TTGTAGATGAGTTGAGGGGCTCTGGAGGTGGTGGCGGTGTATCTATTGCCCGCTGCCGTCCATCCCTAGGCTGCTGTGGTGT
CTCGCCCTGCGCCTGCCTGGGGGCGCAATACTTCTTGATGAAAGCTTGGTTAATATGGGGCCTGATGACCTTGTTGGGGGCG
ACGGGCACTCCGTAGAATTGACAAAGGCCCATAATCAGAGCTGGAAACCTCAGGACCCTGTTGGACTTCTCCGGGTCCACT
GGTGTCTTGCAGGCGCGATCCCTGCAAATATTGGATGACATCAGAAATCAATTGAGAGATGTGCATAGTTACCTATGTCAC
GATGGGGTGACCTTACTGGGGGGGACACCCTGTAGGACTGACAGAGGCCCGTAACCAAAGCTGGAAACCCCAGGGC
CCTGTTGGACTCCTTCGGGTCCATTGGGTGTCTTGTGGGCACGATCCCTGCAAATAGGGGATGGCATCAGAAATCAGTTGA
ACCACGTGCATACTTACCTATGTTACGATGGCATGAGCTTGCTGGGGGGACGGTACCCTGTAGGACTGGCAGAGGCCCG
TAACCAGAGCTGAAAACCCCAGGGCCCTGTTGGACTCCTTCGGGTCCACTGGGTGTCTTGTGGGTGCGATCCCAACTGATA
CTTCCATAGGGGAGTTCGACATTGTGGTCACTGGGCAGAATGTTGCTAAGTAGCAACGTCATTCATATCTGTGTAAGAGTG
GTCATGTTGGTGCGCATGATCTGCACTCGTCTCTTTGCAGTGGCACGGGAGAAATCTTGCCCCGGTATGCACAGTAGCTGCG
CGATAGCCTCCTCCTCTGGTTGTGCTCGCATAGTTGGCCCTCCTCCAGGATCAAGGGGTGGCCCAGGAGCTGATAAAAGGA
AACTACTGGCCCCTTAACCGGGAGCGCAAGTCTCGGTTAAGCATTAAGGGCAGAGGACCTTAAATTCTCTAAAGGTGCGGA
TGTGGAGCCCACTGAAAGTGAGGACACATCGCCCTCTAAAGGCGAGGGCGTGCAGCCCTTTGAAGGCGAGGATGTGTAGT
ACTCTGAAGGCGAGGATGTGTAGTCCTCTCTAGGTGAAGGCATGTAGCCCTCTGAAGACGAGGGCGTGTAGTCCTCTGAAG
GCGAGGGCGTGTAGCCCTCTAAAGACGAGGACGTGCAGTCCTCTGAAGGCAAGGACATGTAGTCCTGTGAAGGCGAGGAC
GTGTAGTCCTGTGAAGGCGAGGACATGTAGTCCTCTGAAAGGTAAGGACATGTAGTCCTTTGAAGGCAAGGGCGTGCAGCC
CTCTGAAGGCGAGGGCGTGTAGTCCTCTGAAGGCGAGGGCGTGCAGTCCTCTGAAGGCGAGGACGTGCAGTCCTCTGAAG
GCGAGGGCGTGCAGTCCTCTGAAGGCGAGGACGTGTAGTCCTCTGAAGGCGAGGGCGTGAAGCCCTCTAAAGGCGAGGAC
TTGTAGCCCTCTCAAGGCGAGGGCGTGCAGCCTTCTCAAGGCGAGGACGCGTAGTCCTCTAAAGGCGAGGGCGTGTAGCAC
TCTAAAGACGAGGACGTGCAGTCCTCTGAAGGCGAGGACGTGCTATCCTCTGAAGGCGAGGACATGTAGTCCTCTCAAGGC
GAGGGCATGTAGCCTTCTAAAGGTATGGACACGTAGTCCTTTGAAGGCGAGGGCGTGCAACCCTCTGAAGGTGAGGATGTG
TAGTCCTCTGAAGGCGAGGGCGTTCAGCCCTCTAAAGGCGAGGACGTGTAGTTCTCTGAAGGCGAGGGCGTGCAGCCCTCT
GAAGGCGAGGACGTGTAGTCCTCTGAAGGCGAGGGCGTGAAGCCCTCTGAAGGCGAGGACTTGCAGCCCTCTAAAGGCGA
GGGCGTGCAGCCCTCTCAAGGCGAGGACGTGTAGTCCTCTCAAGGCGAGGACATGTAGCCCTCTCAAGGCGAGGGCATGT
AGCCCTCTAAAGGTAAGGACATGTAGTCCTCTGAAGGCGAGGGCGTGCAACCCTCTAAAGGTGAGGACTTGCAGTCCTCTC
ATGGCGAGGGCATGCAACCCTCTCAAGGCGAGGATGTGTAGTCCTCTGAAGGCGAGGGCGTGCAGCCCTCTAAAGGCGAG
GACGTGTAGTCCTCTGAAGGCGAGGGTGTGCAGCCCTCTGAAGGCGAGGACATGCAGTCCTCTGAAGGCGAAGGCGTGAA
GCCCTATGAAGGAGAGGACTTGCAGCCCTCTCAAGGCGAGGATGTGTAGTCCTCTGAAGGCGAGGACGTGCAGTCGTCTGA
AGGCGAGGGCGTGCAGTCCTCTGAAGGCGAGGGCGTGCAGTCCTCTGAAGGCGAGGACGTGCAGTCCTCTGAAGGCGAGG
ACGTGCAGTCCTCTGAAGGCGAGGACGTGCAGTCCTCTGAAGGCGAGGGCGTGCAGTCCTCTGAAGGCGAGGACGGGTAG
CCCTCTCAAGGTGAGGACGTGTAGTCCTCTCAAGGCAAGGGCATGTAGCCCTCTCAAGGCGAGGGCATGTAGCCCTTTAAA
GGTAAGGACATGTAGTCCTCTGAAGGCGAGGACGTGCAACCCTCTGAAGGTGAGGACTTGCAGTCCTCTCATGGCGAGGGC
GTGCAACCCTCTCAAGACGAGGATGTGTAGTCCTCTGAAGGCAAGGACGTGTAGTCCTCTGAAGGCGAGGACTTGTAGTCC
```

-continued

```
TCTGAAGGCGAGGGCGTGTAGCCCTCTGAAAGTGAGGGCGTGTAGCCCTCTGAAGGCGAGGACGTGTAGTCCGCTAAAGG

CAATAGGTTCTAGTACCGAAGGGTCCACCCCTATGAGAAAGCAAAAGATTGACTCATCGAGAGAGCCTTTCATCCCAATT

AAAAGTTGGACATTAGATGTTGGAAATCTATGTAGTTAACATGATTTTTAGGGATGCAGATGCATGCAACCTTTGTCTTGA

AATGCGGACTTCGTAACCATCATTGCCCCAGTGTAGGGCTTTGAGGTAACCATCATTGTTTTGTTTCCACAACCTTGTAGCA

AGGAAGAATGAAAGAAGCAGTTGATTCTTGCAAAAAGAATTTTCCAAGGACAAGAAATAGTCAAAGGATTTTTCAGTTGAC

GGATTAAGTCAAATGACTCCTATTCTTGATAACTCACTTATCTCTAAAAAAGACAAACTTTCCGGAATGATAAAATGAGTCA

CATGAATGTCTATATTTTACTTGAAAACACAGTCAATCAAATGCTTTTTTCCTTTTCTTTTTCCTTTTCTACTTTACTCGTTG

TTTACGGCATCCTCACCAAATGTGTAGCACGAGTAATTTCTAATTGAACGGTCTTGGAAGTCCAAACTCAGGAGTGCATGTC

GCTTGAGCAAACAAACCAATGGCTTGCACCCACATTCCAGTGGAAGCAAAGATGTAATTACGAGAGGATGAGGGACAAAG

ATGTCAAATTTATTCATTTTATTTAGCATTGTAACTGTGGTTTACAATAATGGCATAAACTTGAAAATCCTGATGAGTCATTA

GAGACATCTAACAAAAGCTTTCAAATATCTTATAAAGTTTTTAAGTAAATATTACATCTTGAAAATTATGTATTTCTCTCTGG

TAACCGATTACTAGAGGCTGTAATCGATTACCAAAAGAAAAAATGTTTTTTAAACAACTTTCAGAAAAGTTTAAATTTGAAT

TTTAAAATCTATAATCGATTATCACTATTGTGTAATCGATTACCAGTCACAAAAGGTTTTGAAATTCAAACTGAAAAGTCAT

GACTCCACAAAATTAACTGTGTAATCGATTACCACATATCTGTAATCGATTACCAGTGAGGAAATTTCAGAAATAACTCTAA

AAATTCACAACTCTTCATAAATTTTTTTGAAAGGTCACCAAAGGCCTATAAATATGTGACTTGTGTTCGAAATTCTTCAGAG

TTTTTCAAAACATTCATTGTCCTATCCTCTCACAAGAAAACCTTTAGCCAAACACTTGCAAAATCATTAAGGATTCTTATAA

GTTCTTCAAGTTGTATCATTCTTCTCTTAAAGAGAGAAAAACATCTTATGTACTTCAAAAGCAATCTGTTGTTGTAATCAAG

AGGTAGTGGGTCTCTTGATTTGTAAGTTCTCTGAACACAAGGGAAGGATATCCCAAGGTGGTTCAGAAGTTGTAAAGGAAT

TTACAAGTATAGTGGAAATCTCAAGTGAATTACTTGAGGACTGGACGTAGGCACAGGACATGGCCGAACCAGTATAAAACT

GAGTTTGCAATTCTCTCTTCCCTAAACTCTTTTACTTTATTGCAATTTATATTTACTTTGCATATTCAAAGAAGCATCAAGTA

AATTGTTTATTACTTCTTTTTTCTGCATATTAAGTCTACATATTTCTTTTAAAGAGAGAATTAAAACTTGTTAGGAGAAATTTT

TTAAACTTAATTCACCCCCCCCCCCCCCTCTTAAGTTATTGAGTTTACTTGTGTAACAAGTGGTATCAGAGCTTAATTCTTG

TATAAGGTTTAGAAACTTCAAGAATAGTTATGGCCTCATCAAATTTTTTATTTCCCGAAGAGAACTCTATAAATAGGCCTCC

TATATTCAATGTTGTGGGTTATCATTACTGGAAAACCCGAATGCAAATTTTCATAGAGGCTATAGATTTAAACATCTGGGAA

GCCATAGAAATTAGTCCTTACATCCCTACTATGGTAGCAGGAAATGCAACTATAGAAAAACCTAGGGAACAATGGGATGAA

TAGGAAAGAAAAATGGTACAATATAATTTAAAAGCCAAAAATATAATTACATCTGCATTAGGCATTGGATGAATATTTTAG

AGTATCAAACTTCAAGAATGCGAAAGAAATGTGGGATACCTTACAAGTAACCCATGAAGGAACAACATATGTAAAAAGGT

CTAGAATAAATACCCTAACCCATGAATATGAATTGTTTAGAATGAATCAAAATGAAACTATACAGGATATGTAAAAGAGAT

TCACACACATAGTAAATCATCTTGCATCATTAGGAAAGATATTTCCCAATAAGGATCTTATTAACAAAGTTCTAAGATGTTT

AAGCAGGAAATGGCAACCAAAGGTAATGGCTATTACAGAATCAAGAGATCTTATTAACATGTCTCTTGCAACTTTGTTTGG

AAAACTTCAGGAACACGAAATGGAACTCATGAGACTAAATCAACATGAGGAAAATGGCAAGAAAAAGAAAGGAATTGCAC

TTAAAGCTTCATCTTCAATTCAAGAAGGAGGTGATAAAGAAGATTTGAATGAAATAGAGGAAGATGAGGATTTTAGTTTCTT

CGTAAAGAGGTTCAATAAATTTTTAAGAAACAAAGGAAATAAAAAAAGATCAAATTTCAAACCAAAAAAAAAGAGGAGAA

GATTCACCCTCTCTTCCAAAGTGTTATGAATGTAATCAACGAGGACATCTGAGAGTTGATTTCCCAAGTTTCAAGAAAAGAA

TAGAAAGATCTGAAAAGAAAACCTTCAATGATAAGAAAGCAAAGAAGGCTTACATCACTTGGGAAGACAACGATATGGAT

TCATCCAAAGACTCAAAAAATGAAGTTGTGAATCTAAGTCTGATGGTAAAAAATTATGAAAGCGATGAAGAGGTAACATCT

TCTAACAATAACTTATCTATTTCCTTTGATGAACTTCAAGATGCATTCATTGATTTACATAAAAAATCAGTCAAACTTGCAA

AACTAGTTTCATTTTCTAAGAAAACTATTTCAAAATTAGAAAAGGAAGTTTTAAAATTAAATGAAGAATTAGAAAATCTTAG

AACTGAAGTCAAAACTTTAAAACCAATTGGCACAAATCAATCTTCCACCATAAAAGTAATAAATGATAGTAAAAAAGCATG

TAATTGTTGTAGCAAGTTTATAGAAGAAATCAAGGATCTAAAAAATTCTCTTTCCAAATTTATTGTTGGCAAAAATAATCTA
```

-continued

```
GATATTATATTAGGAAAGCAAAGATGTGTGTTTGATGAGGCTAGATTAGGATATAGACCTGATAAACAACAAAAGTTATAT
AAAAAATTCTTTGCATCCAATCAAAAGAATAGTTCTCCTTTCTTAACTTGTTTTTACTGTAGAAAGAAAGGACATGGTGCAT
CTACATGCTATTTTAGGAAAAATAATAATAATATTAAAATGATATGGGTTCCAAAAGGATGTTTTTATCAAAACTAACATTC
AAGGATCCAAGAAAGCTTGGGTACCTAAGTCATAAACATGATCATATAGGTTTCTTTGAAGAAGAGTTGGTACATAGATAG
TGGATGCTCTAAACACATGACGGGAGATGCATCAAAGTTCACTCATATTTCTCCCAAGAATAGTGGACATGAGACTTATGG
CGACAACAATAAAGGTAGAATCCTTGGAGTCGGAAAAATAGGTATGAATTCATCTACCTCCATTGAAAATGTTATACTTGTT
GATGGTCTTAAGCACAGTTTACTAAGTGTTAATCAATTATGTGATAAAGGCTATCTAGTATCATTTGAATCTCATAACTGTGT
TGTTGAAAACAAACATGATAGAAATATAAAACATATAGGCTATAGATTAAATAATGTTTACATGATAAATTTAAATAAAAC
ATTAAATCATGATCAATGTTTTCTTAGTAAAGATGATAATCCTTGGTTATGGCATAGAAGAATTGCCCATATAAACATGGAA
CATTTAAATAAACTAATTTCTAAGGATTTAGTTATTGGTTTACCAAAACTTAAATTTGAAAAGATAGATTATGTGACGCTT
GTGAAAAAGGAAAACAAGTAAGGGTTTCCTTCAAATCAAAGAATATTGTGTCTACAACTCAACCATTACAACTTTTGCATA
TGGATCTTTTTGGCCCCTCTAGAACTATGAGTTTTGGAGGAAACTACTATGCTCTTGTTATAGTTGATGATTAATCAAGATTT
ACATGGACATTATTTCTCACTCATAAAAGAGGTGTTTTTCATGCTTTCAAGAAACTTGCTAAAATTATTCAAAATAAGAAAA
ATCTCAAAATTGTATCTATTAGGAGTAATCATGGAGGATAATTTGAAAATAAGGATTTTGAATCATTTTGTGATGAAAATGG
CATTGGACACAATTTTTCTGCACCTAGAACCCCTTAACAAAATGGAGTAGTTGAGAGGAAAAATAGATCTTTAGAAGAAAT
AGTCAGAACTTTGCTTAATGATGCAATCCTTCCTAAATATTTTTGGGCTGAAGTTGTAAATACTGCATGCTATATAATGAAT
AGAGCTTTAATTAGACCAATCTTAAAGAAAACTCCATATGAATTATATAACAGAAGAAAATTGAACATTTCTCATCTTCATG
TGTTTGGATGTAAATGTTTTGTGCTAAACAACGACAAAGAGAACTTAGGTAAGTTTGATGCAAAATTTGATGAAGGTATATT
CCTTGGCTATTCCTTGCACAGTAAAACATTTAGAATTTATAACAAAATAACTATGATCATTGGATAATCTATCCATGTTGCTT
TTGATGAAACTAACTCAACTGTGCCTAGAAAGGATACTCTAGATGATTTTTCAGATTCTTTAGAAGGTATGCATATTCATGG
TGAAGAGCACAAAGGAAAAGGAAAGGGAAATGATGAAAAATTTCAAATTGATGAAACAAAAACAAGTACAAATCTTCTAA
GAGAGTGAAGAACTTCTAGATACCATCCGCTTGACAACATAATCGGTGACATATCTAAAGGGGTAACAACTAGACACTCTC
TCAAAGATGTTTGCAATAATATGGCTTTTGTTTCTTTGATTGAACCTAAAAATTTAAAAGAAGCCATAATTGATGAACACTG
GATCATAGCTATGCAAGAAGAGTTAAATCAGTTTGAAAGAAATAAAGTTTGGGAATTAGTTGAGAAACCTGATAATCATCC
AGTTATAGGAACTAAATGGCTATTCATAAACAAATTAGATGAACATGGAATAATAATTAAAAATAAGGCTAGGCTAGTAGC
CAAAGGATATAATCAAGAAGAAAGAATAGATTATGAGGAAACATATGCTCCAGTAGCTAGATTAAAAGTCATTAGAATGTT
ATTAGCCTTTGCATCCATAATGGACTTCAAACTTTGGATGTGAAAAGTGCCTTTTTAAATGGTATTATCCAAGAAGAAGTAT
ATGTGGATCAACCTCCTGGCTTTGAAAACTCAGAAAAGCCTAATCATGTCTTTAAACTGAAAAAGGCTTTATATGGTTTAAG
CCCCTAGGGCTTAGTATGAACGTCTGAGTAAATTCCTTTTAGAAAAGGGTTTTTCAAGAGCTAAGGTTGATACTACCCTTTT
TATTAAAAGAAAATTGAATTATATACTCTTAGTACAGATCTATGTTGATGATATCATTTTTGGGTCAACTAATGATTCTCTTT
GCAAATAATTCTCGCAAGATATGCAAAATGAATTTGAAATGTCAATGATGGGCGAGTTAAACTTTTTTCTTGGACTACAAAT
CAAGCAAACAAAGAATGGAATATTTATTAGTCAATCAAAATATTGCAAAGACCTGATTCACTGATTTGGGATGGAAAATGC
TAAACACATGACTACTCCAATGAGTACTGCTTGCTATCTGGATATAGATGAAATCAGTCAGTCAATAGACATAAATAAATA
TAAAGGTATGATCGGATCTCTTCTTTATTTATCTACAAGTAGACCTGATATAATGTTTAGTGTTTGTATGTGTGCAAGATTTC
AAGCAAATCCCAAAGAATCTCACCTTAGTGCAATTAAGAGAATCATGAGATATCTATTAGGCACTATTAATCTAGGGTTAT
GGTATCCTAAAAATTCTACTTATAATCTAATAGGATACTCTGATTCTGACTTTGTCAGATGCAAAACTGATAGAAAGAGCAC
TAGTGGAACTTGTCATTTCATTGGCTCTACTCTAGTTTCATGGCATAGTAAAAAACATAATAGTGTTGCTTTATCCACTGCTG
ACGTGGAATATATTTCTTCTGGCAGTCGTTGTGCACAAATACTTTGGATGAAACAACAACTTTCTGACTATGGATTAATTCT
TGATCATATTCCTATTTGATGTGATAGTACGAGTGCAATAAACCTATCTAAAAATCCTATTCTGCACTCGAGAACCAAGCAT
ATTGAGATTAGGCATCATTTCTTGAGAGATCATGTTCAAAAAGGGGATTGTGTACTAGAATTCGTTGACACAAAGAATCAGT
```

-continued

```
TAGCTGATATCTTTACAAAACCTCTCCCCAAAGAAACATTCTTTGTTATTAAAAGAGAATTAGGACTCCTAGATATCAATGA
CTTAGATAAATAGTTAATTTGTTTGTTTATTATTTTTCTTTTGGTTGTTAACTTTTGATTGTCCTTGCTGATTGTGTTTGCTTT
TGATATTTATTGTTGATTAAGGTTTAATGATTATTTTTGCTTGAGTTTTTGAGTGTCTTTGATGATTATGTTTAATAGTTATGG
TGATTGTTGATTGTTGTTGATGATTATTTTTGAAATTTTGATTGTCTTTGATGAATGTGTTTGAGAGTTTTTATGCTTATTTTG
ATTATTTTGATTGTTGATTGTTGTTGATGATTGTTATACTGAGTGTGTAAGTTTTTTGAGTGAAAAATAGTTAGTTTTAATGAA
AAATCTATGTTTTTAGGGTCTGGTAATCGATTACCACTCCCTGTAATTGATTACCATAGAACATGACCCTATAATCAATTAC
AATAGACTGTAATCGATTACTAGAGGGTTTGGTCAGATATAGGTTACGCTTGTAATTGATTATCATGGGCTATAATCAATTA
CAGCTCGTCCCTGTCTATAAATACTGCATTTTTCTCTCTCCTTGTGCAACCCTCTTCTCCCTCACTCTCCTTGACGGCGCCCC
TTCCTCTCAAAACTTCAAATCACCATAACTTTCTCGTTTCTTGTCCAAATCACTTCAAACAAAGCTCAAATTTCTTCTTTTTC
AATTCTCTACAAACTCCACTGATCATAATTTTCTTAAGAAAGCTCAAATTGCAAAACCCGCAAAGAAGAGAAAGGACTCAT
CCTCCACCACCACCACTGCAGGCCAACACTGCCACGGCACATCCGGTGACCCACTAGCACCAAAACCCCCTTCTTTTTCAT
CTCCCAAGTCATTGACTCTATTTTCTTCCAATGACCAACTTCAAAGGTACTATTCCCAATTCTCCAATTGTGCCATTCTCGAT
CCTAAGTATTTAGATGTAGAATTCTTTGATGGGGAAACCTTTGATTGCTATCAAGTGTTTCAAAATTCTGAATTAGTTGAGTT
TATGTCTCTAAAATTACCATATTATCCTGAATTAGTTAGAGTCTTTTACAATAATCTTAAAATTCAGGATGAAGTCATTTTTT
CTGAGGTGCATCAAATACCTATTGTTGTTGATCAATCTCTATTTTATTCTCTGACTAAACTGAGCAGTCAGGGTGTTCCTTTT
GAAGGCACTCTAGTTGATGATTGGAAGCATGTTTATTCTAGTCATGATGCTCGTAAAATGGTCTGTAATGACCATACTGATA
TGACCGGTAGATTGCTTGCTAGCTCATTCACCTTTGAGTGTCGCATCATGCATTATATCCTTTTTTGAGTCTTGCTTCCCCGG
TTCACCAATCTTGCTCAAGCCTTTAAGGAGGATTTAATCTTGCTATGGGCTCTTCAAATCGGTCGCCAAATGGATTGGGCCC
ATCTTGTTAGGTACCAAATGCATAAGGCATTACGAGTCAATGCACCTCTTCCATATCCTCATCTTGTCACTTTGTTTCTTCAG
CATTTCAATGTTCTTTTAGAGGATGAACCTTTTGTTAAGGTTAAAAGATCCTTTGCTATTGGTGTTGGTGCTATTACCTCCTT
CGGATACCAGAAGGATATGGATGGCCAATGGGTGTATAAACTGTAGAAGCAAGCTTCATGATGATGAATCAAGTTGATTCA
AGATGTTTTGATGATAACAAAAGATGATGACAAAAAGCCCAAGAGAATGATTTCAAGATTGAGTCAACAATTCAAGAATCA
AGAGAAGTTTGATTTCAAGATTCAAGAGAAGATGAATTCAAGATTCAAGAGAAGAAATCAAGAAGACTTCACAAGGGAAG
TATTGAAAAGATTTTTCAAAAAAACAAACATAGCACAGTTTTGTTTTTCAAAAGAATTTTTCTCAAATTTTCTAAGTTACCAG
AGTTTTTACTCTCTGGTAATCGATTACCAATTTCCTGTAATCGATTACCAGTGGCAAAGTTTGATTTCAAAATTTTTCAACTA
AATTTGCAACGTTCCAATTGATTTCAGAATGGTGCAATCGATTACAAGATTTTGGTAATCGATTACCAATGCATCTGAATGT
TGGAATTCAAATTCAATTGTGAAGAGTCACATCCTTTCATAAAATGCTTTGTGTAATCGATTATAAGGATTTGGTAATCGAT
TACCAGTGACAAGTTTTGAACAAAAATCAAAAGATGTAACTCTTTCAATGGTTTTCAGATTTTTCTAAAGGTTATACTCTTTC
AATGGTTTTCCTGACCAGACTTCAAGAGTCTATAAAAGCAAGACCTTGATTTGCATTTGAAATAATACTGACAACCTTTACA
AACAACTTTTCCACATATTCTTTTACAACCTTTGAATTTCTTTGAACATTTTCTTGAACTTCTTCTTCTTCTTCTTCCTTTCCA
AAAGCTTTCTAAAGTTTTCTGGTTTTTCCAAACCTTGAAAATAGAAGTGTGCTATATCTTTTATTCTCTTCTCCCTTTGCCAA
AAAGAATTCGACAAGGACTAACCGCCTGAATTCTTTTTGGGTCTCTCTTCTCCCTTTTCCAAAAGAACGAAGGACTAACCGC
CTGAATTCTTTTGTGTCTCCCTTCTCCCTTGTCAAAGAATTCAAAACGACATAGTCTGAGAATTTTTTTATTCTTCCTTTTCC
CTTAAACAAAAGAATTCAAAGGACTAACCGCCTGAGATATCTTTTGTTTCCCCTTCACAAAGTTTCAAAGAACTAACCGCCT
GAGAACTTTGTCTTAACACATTGGAGGGTACATCCTTTGTGGTACAAGTAGAGGGTACATCTACTTGGGTTGTTGTAACTGA
GAATAAGAGAGGGTACATCTCCTGTGGATCAGTTCAAGTGGAGGGTACATCCACTTGGTTGTTCAAAGAGAACAAGGGAGG
GTACATCCCTTGTGGATCTTTGCTTGTAAAGGATTTTACAAGGTTGAAAGAAATTTCAAGGACCGTAGGTCGCTTGGGGAC
TGGATGTAGGCACGGGTTGTTACCGAACCAGTATAAATTCTTGTGTTTGTCTTCTTCTTCCCTGCACTCTTTAATTTCCATTG
TGCACTTTAATTATCACTTTTACTTTTGGTTAAGTTTCTATTTTTGTTCTTTACTTTCTTAACATTATAGTAAAAGCCTAATCG
AATCTAGTAATATTAAGAAGGATAGATTTTTAATTAGTAAAGGTTCACTAATAATTAATTCAACCCCCCCCCTTCTTAATTA
```

-continued

```
TTCCGAGACCACTTGATCCAACATAAACAAGACCTGCCACCTCCCATTCTCGATGAACGCACACCCTCTCTACCACCGCAA
CAAGATACCTCCTCTTCCTTATTGAATGACGTCCTAATTGAGTTACAGGTGTTAGATCAAGTGGCCTCATAATAATTAAGAA
GGGGGGTTGAATTAATTATTCTTAAACCTTTACTAATTAAAAATTTACTCTTCTAAGGCTTTTACTTATGTTGTTAAGAGAAT
AAATAGTAGAAGAGAAACTTAACCAAAAGTAAAAGCGGAAATTAAAATGCACAGTGGAAATTAAAAGAGTAGGGAAGAA
GGAGACAAACACACAAGAGTTTTTATACTAGTTCCACAACAACCCGTGCCTACATCCAATCCCCAAGCAACCTGCGGTCCT
TGAGATTTCTTTCAACCTTGTAAAAATCCTTTTACAAGCAAAGATCCACAAGGGATGTACCATCCCTTGTTCTCTTTGAACC
TAGTGGATGTACCCTCCACTAGAACTGATCCACAAGAGATGTACCCTCTCTTGTTCTCAGTTAAACCCAAGTAGATGTACCC
TCTACTTGTACCACAAAGGATGTACCCTCCAATGTGTTAAGACAAAGATCTCAGGCTGTTAAACCTTTGATACTTTGTGAAT
GGGGATACAAAAGAATTCTCAGGCGGTTAGTCCTTTGAACACTTTTGTATAAGGGAAAGGGAAGAATCAAAAAAATTCTCA
GACTGTGTCGTTTTGAATTCTTTGACAAGGGAGAAGGGAGACACAAAAGAATTCAGGCGGTTAGTCCTTTGTTCTTTTGGAA
AAGGGAGAAGAGAGACACATAAAGAATTCAGGCGGTTAGTCCTTGGCGAATTCTTTTTGGCAAAGGGATAAGAGAATGAA
AAGATGAATAGCACAAGTTTTCAAGGTTTAGAAAACCAGAAAACTTTGGAAAGCTTTTGGCACAAATAAGAAGAAGAAGTT
CAAAGAGATTCAAGGCTTGTAAAGGATTGTATGAATTAGTGTATTGAAAAGAAAATCAAAGCCTTGCTTTTATAGACTCTTC
ATGTTTGGCCAAGAGGACCATTTAGAAGAGTTATAACTTTTAGAAAAACTTAAAACCAATTTGAAAAAGTCAAAAACCTTT
TGAAGAGTTACATCTTTTGATTTATTCAGAAACAATCACTGGTAATCGATTACCAAATCAGTGTAATCGATTACACAAGGCT
TTTATGTGAAAGGATGTGACTCTTCACATTTGAATTTGAATTTCAACGTTCAAAGGCACTGGTAATCGATTACCAAAACATT
GTAATCGATTGCAGATTTTTGAAATTAATTGGAACGTTGTAAATTCAATTTGAAAACTTTTTCAAAAACATTTTGCTGCTGGT
AATCGATTACAACAATCTGGTAATCGATTACCAGAGAGTAAAAACTCTTTGGTAAACATGTTTTGAGAAAAATCATGTGCTA
CTCAATTTTTGAAAAAAAAAATTCATACTTATCTTGATTAAGCCTTCTCTTGATTCTTGAATCTTGATCTTGATTCTTGACTCT
AAACTTTCTTCTTAAGTCTTGAATTCTTCTTGATTCTTATCTTGAACTCTTGAATTGTTCTTGATTCACTTGAGTTGTTCTTTG
ATTGATCTTTGAGCTTTTTGTCATCACCTTTGTCACCATCTTTTGTTATCATCATTGTTATCATCAAAATACCTTTGAATCACC
TTTTTGTCATCACCTACGGATTCTTAGACGTTTCTAGTATTATAAGTCCTTAATTTTCTAGACATTTTACTATTTGTGCCCTGT
ATTTGGATTTTGTTATTTATCACTTTGGTTAATTTTGTGCTTTGCTTTGGATATTTAGCATTTGGCCGGTTTATGCCTTGCTTTG
AATATTTTGCACTTGCTTCTATTTTATATTTTGCTATGGATGATTAGTTTTTGTTGTTGGTTGTGATGCTTGCTCTAGATATTTT
GTGGCTTTGATATTTTCTTCTGTCTTTTTCAGCTTTTTGATGTTTCCTAAGGGTAGAGAAACTAAGGGTGGATCTTATCTAAA
ACTAGGCAATAAATTGCAAATTTAAGGGGGAGTAAGGGTGAGTGCATGCATTGCAAATCGAATATCGTTTATCTTGTTTTCA
GATTGTTGTCATCATCAAAAAGGGGGAGATTGTAAGTGCATATGTTGTATGAAGATTTTGATGATGCCAAAAGATTAAAGCT
ATTCAACGTTGATTCAAGTCAAGATCAAGAAATCAATAGAAACAATTTACAATAGTCCTTTATATGTTAAAAGAATCTCTTA
AAAAGGTTACAAAGGTTTGGCCTTAAAAGACTTAAGTTTTCAAATATCTTATAAAGTTTTTAAGTAAATATTACATCTTGAA
AATTATGTATTTCTCTCTGGTAATCGATTACAGCCTGTTGTAATCAATTACCAGAAGCAAAAATGTTTTTCAAAAAGCTTTC
AGAATCAATTACCAATCACAAAAGTTTTTGAAATTTAAATTGAAAAGTCATGATTCCTCAAAATTAATTGTTTAATCGATTA
CCACATATCTGTAATTGATTACCAGTGAGGAAATTTCAAAAATAACTTTGAAAAGTCACAACTCTTCACAAAGTTTTTTGAA
AGGTCACCAAAGGCCTATAAATATGTGACTTGTGTTCGAAATTCTTCAGAATTTTTCAGAACATTCATTGTCCTATTCTCTCA
CAAGAAAACCTTTGGCCAAACACTTGCAAAATCATTAAGGATTCTTATAAGTTCTTCAAGTTGTATCATTCTCTTAAAGAGA
GAAAAACATCTTTTGTACTTCAAAAGCAATTTGTTGTTGTAATCAAGAGGCAGTGGGTCTCTTGATTTGTAAGTTCTCTGAA
CACAAGGGAAGGATATCCCTGGGTGGTTCAGAAGTTGTAAAGGAATTTACAAGTATAGTAGAAATCTCAAGTGGATTACTT
GAGGACAGGATGTAGGCATAGGGCATGGCCGAATCAGTATAAAACTGAGTTTGCAATTCTCTCTTCCCTAAACTCTTTTACT
TTATTGCAGTTTAATATTTACTTTGCATATTTAAAGAAGCATCAAGGAAATTGTTCATTACTTCTTTTTTTGCATATTAAGTCT
ACATATTTCTTTTAAAGAGAGAATTAAAACTTGTTAGGGAAATTTTTTAAACTTAATTCACCCCCCTCTTAAGTTATTGAGG
CCACTTGTATAACAAGTAAGGTTGCATTTTCCTTATAACCACAATTTCCATTAGGTCTAATGTCAACAACTTTTACATGAACT
```

-continued

```
GTTGCAACAGATAGGGAAAATTCATTCATATAAAGGATTTTTTTTGTCCACTTTTTGCTACTGACTTCTTTGCGAGCCACAC

TTGGTGTTCTCAAACTACCAACCATCATGTTTCACCAACTCGTTCTCACATTAAAGGAGCACATTTAGTAGATTTCACAGAC

TTCAATGCACCCTTTGTTTTTACTTTCTTTGGAGGCAAACTTATTAAAGTGGTATCCGAAAATGCAAGTTCATGGACCTTATT

CTTTAATGTCATTTTTATGCTCACATCAAGCTATGAAAATCTCTTTACCAATGCATCAACCTCATTTGTGAGAGTTAAGTCCC

CCCAAGAATCACCTGCGTTGTGTGTACCATTGATGAATAACATCTTCCAATGCACATGAATGGACAACAAGGGTATTGAAC

CATTGATTTGGCTATACCTAGCAAGTTTATAGGCACACGGTAAATCATGAATAGTTCTGAGTGTGCAGTCACAATTAAAACT

GTCAACACTAATGGAAGCAAAGCGCTTCAACACAATTAAAACTTTGTGCTTCGTAGTCTTTTGTAAAACGGTGTATTGAACT

TGTGGTCAAGCACGTTGATGCTTTTTTGAAATGACGCCTTAAGTTCAGTATGTTGCAGTATAAGCATGTTATTCATTGCATCC

CAGCAAATACACAAGTCTCCTATGCTATCATGAAACAACCTCTTTAGTCTTGCTTGTGCGCCTTCAACTCTGTAAAGTAGTT

TAATGTAATATCAATAGAAGATACATAACAAACAAAATGTGAAACAAGTAAGTAATTACAAAAATCTACCTATTAGTTGTG

TTTCCAAGATGCATAACACAATCAGTTCATGCTTGTACAAATCTCTCCGTATAATGCAACAACCATGTATAATAAATATACT

CTTGAAAATCCACATAATGTCTACAAATGCTTGTAAAGCTTTTTAACTACTACTCATATATTTGTTCATCAATAGAATTCACC

AATCCTACCCAAGCATTCATCACAACCTCCCAGTCTTCTGCATTAGTCACGAGTATCTTGCATTTTGCTCTGACATTCTTAGA

AACATGGAATTAACATAACAAGTTGGTTGCAAAAGGAAAGGCAACCTCCAATGCATTCATCAAAGTAAGATCTTTGTTAGT

GACAATCACCTGAGGCAGCATATCATCCTTCACAAACAATCCTTTGACCTTTTTAAATCCCATTCAAAATTCTTCATCCTCT

AAAATTGTAAATAAGCAAATGCAAAAAAAAAAATCATTTCTGTTGAAGTCACACAACAATCTCCAATAGTGGAAGATGATA

TTTGTTCGTCTTCCAAGTAGTATCACAAATCAACATTGTGGGAATGCATTTAATAGCTTGATGAAATATGGATGAGACTACA

TTATATCTTTGACAACATCTTGAGTGTCCACTCTTTTGAATCAATATACATATTGATTGTGCTCTATCAACTTTAGTAGATGT

TGTACCTTCGTTCATGGACCCCTCACTACTAGAAAAAGCATTTTTCACATCAGTTCTTTAGTACATTTCATGACGGTTCAAA

AATCATCTTTGAAGTCGCCATCATGGAAAGTCAACACTTTCCACGATAGTTTTTAAACAGTCTTAGCATCTTGATTTCTACAT

CGGTTCTTTTTTAAACCATCTTAGAATGTGTTTTTTTGTCTTAAAAATGTTTTAAAAAAATGATATTTCTAAGACATTTTTCTG

AAAGAATTATCTTGGAAAGTCTCTAAACAAACCAAAAATTTATTGAGGCTTATTATTTATGAATTAATTATTTAAAAATATA

ATATTTCTATTTGGAAACAAAATCATTGTTTATAATATATTGAAGTAAAATATAAACCTAAAATTATTTTATTTTTATTTAA

ATATAATTAAAAAGTTATAAATATAATAAAAGATTATATGTTTTGCATATGTGAATCTACAAACAATTTACAATAATAATAA

AGGAGGTATATGATAATTTTTTATATAAAATCTACCTAGTTTTTTCTTATCATGGAAATGAATGTAGTAGGATTTGAAATAT

ATACATTCTCCACATACATATATATCATGAAATGTGAACTACAAAGTTATTATCAATGGGGTTGACTACAAAAATTGAATGT

GAAAAACAAACTAAATTTTTCTGAAATTAAAGTTGTCCTATAAACTAAGTAGTTTCAAGAGAAAGATGAGAGTTAGCACTT

AACATAATTTGTAATTAAATTATCACCATCAATTCAACGGTCAAGATTAATTTCTAATCGAATTGGGTTCATCAAAATAAAC

CTTCACCACCTCTAACCTCTTCAATTTTCAACCAAGGGTCAATAATTTCGCTGATCAACTCGATGCCTCTTCAATACACTAC

TCAAAGAGGTTGATTCATCACCGCTGGGCAATGTAGAACTAAGCATCTCAGACGAAGATCAGGATGCCTCATCCTGTAACC

ATAAACAAATTGCAAAGATTAATTAATCAAGAATGAAAATATCCTCTAATAAATTTTTTAATAATGAAGTACTCACATTGTA

AGACTTTCATCTACTTACAAATTATAAAAGATCATTAGTATGATTTTTAAAATAATTTTATAAAAATCAATAAACTTATTATC

ATGTATATAATAATTTTTTATTGAATAATAATATAAAAACTTTCTATCTTTTCTTTATCTTTGAAACAAAATATTAGCTTAATA

TCTAAAAGCATATTCAAAGTTAAAATAATAACAATGTCAAAAATGAAATCCTTGATAGATTTATAAGGTAAAGTTTATTACT

TAGAATAGACCATTACACCATTGGTATCACTGATTTACCGTATCAAGAAAATACAACCTCCCAATTGCAAGATATTATCAA

AAAAACAATTAATAAACTAATCTAATATTCTAAAACAATTAGTCCAAACATTGCCACAAAGAATATAAATTAAAATTTGCA

TAGTTGCACCATAGAGCACTCACTTAGTGAAAACCACAGAACGAGGGCGAAGTAATCTCGAACCTTACCTAGTGGAAAGA

AGGCACAGATCTAAAGGAGATATAAACAAAAGACAAAGAAGATGAAGCACAAAGCAGATTAAGAACCTTGTTACAACC

CATTCCACAACACGTTTATATTTTGAAAAAGAGAAAATAGTATATTAATTAGTTTTTTTCACCTTTTCAATCATAAATAATA

ATTAAATTCATTAATTTTAATCACAATAATAATTAAAAATAGGTTATTACTTTTTAATTATAAATTTATGCTTAGAAAAATAG
```

-continued

```
ATCTCAAATAAGTTAGTAGGCCCTTCCCTACATAGCAGACATTGTGGTCTGAGGGGAAAAAACCGTGAGGATACAAATCCT
AGAAGCCTAATATAATCAAACTAAATAAGAACAAGATTTATATTTGAAGAATTTTGATCCATTAAACCACAAGGAATCAAG
TATTTAAATAAGAAAGAATGGGCAATAAGCAGTCACACAAGAAATTCCCTTGAAAGTACTTCTAATAATGGATAAGCATTG
ATCAAATGGCATAACAATTTTACACATAAAACAATTATGTTTCTTAATCAATGACAACTACTTTGGGGTCCACTTGTTAGAT
AAAATGCATCCATCCATAGAAAAGGGGGTTATAAATTTATATTATAATAAAAAAAAATCAGCATCCTTCGTTCAACGTTTCT
CCAAGTCTTCCTGATCTAGAAGTTGAAACTCTCATTCAAATCTCTGGATTAACCTGAACTTTGTTCTTTGCAAAGTATCTCAT
CCTATCCCTAACTATATTGTGTAATATTCGATAGTAGAAGCATTTCAAATGAAAAAAAAGGTAGACTTCTTTAAATCTTTCA
GAAGGTAGTGATTCTTTTGTCCGCAATGCGTATTGAGAAACACAACAATAGTAATGGTTCAACTTTCATTTTAAAGGTGAAA
AAATATATAATAAAATTAAGTTTAAGCAACTTACTATGTATATACCAATAGTTATATATGTTAATGCTAGTTCATAATTTCAC
TAATTAAGAGTGACAAGAACTACATTCTTTAAAACTGTTGACATCTTGCCCAATAGACATGAATAAAGCAAATTACAGATTT
GACCAATCATATAGAGAAGCACACAGACCTAAATTATGAAAAATGAGATTGCACACAAAATTTGAAAGTTATCTAAAAAAT
AAAAAATAAAAAACAGAATTTATCCAAAAATATCTAGTATGTACAACTCCTTTTATCCCTCCACTTTGTGCTAAATAGTAAA
GAGGACAAAGAAGAGAATTTTGAGCTGATTGTGATGCAAATTCCCTACATACCTCTAATCCACGCAATGCACCAAAAATAG
TATTTGCCTAGAATAAATAAAATCACAAAAAACTTAAAAGACTAATGGCCAATTAGAAATGACTATCATTAAAGAAATAAA
AAGATAAACCACATATTGCAATTTATTTGTTTTTGTCCATTAACCATAAGAAAGGAAGCACAACATCATAAGAGTCTTCTTT
ATCAATCAGTTTGTTTCCCTAAAAACAAAACACTCAATGAACAAGTGTTTCAACAAATTCCAATTGCTACTATGTGGCATTT
TAGAATGGTGTTGATGGATTGGTTAACTTGTTCAATGCACAGAAAATTACGACATTATTAAACTAAGAAATACATATATAAAG
GAAACTAGTTTTAACTTAGGAAGGGAAAAGTACAACATAACCTTCAGAATTTAAGTATCCATTAGCCAACAAACAACATAA
TCTCATTGAATATTCAAATCCATTAACAAACACTACCATAAAAATTATTTATTACGATGCGCCAACAAAGATGGTTGACAAA
AATCATCTTTGAAGACAATGTGGTGACAATGTCATAATTAAGTTCATTAATAACGAAGACGATTTTCAAATAACCATCTTGG
AATTGTGAATTTAAGGATGATTATTCAAAAAACCGTCGTAATTGAACACAATACAAAAATGGTTTTACAAAACTGTCTTTGA
ATGGTTTTGCCTTTTCAAATTCACGCTTTCTCTCTCTCTCTCTCTCTTATCTTATCAGGTCTCTCTCTCTTATTCTCAC
TTTCTTTCTCTTGCTCTCTATTGTGAAACCCTCATCTTCCCTTCCCTTCTACATTTGCAATAACAACAAATTTAATCATCTT
CTCACTGATGAGTTCGTCCCTGTCAACACCAATGCCGACAAGCTCTACGATGAGATGCTCAACCTTCAGAACATTGTCGCCT
TCCTCCATCGCACCAAGATCAACGCCTCCACCGATTCCTCCGTCACCACCGGCTCCGACCTCTGCAACGTCATCACTGGCG
CCCGCTAGATCCCTGGCGAGTCACGCCTCAACCTCCTCTAGAGGAACTTCTCCCTCTTTCATGCCATCATTGCGCTTCTCGT
CCGTTACTCCCCCGACACCATTCTACTCATCATTTCCTACCTTGTCGACATTCTCACCTATGTCGCTTGGAAGCTTGAGCTCA
TGTAGGTAATGAACTCTGAGAGTGCAAATTGATTTTTTTTCGCACAAAATAAGATGGTTTCCTATATACTAGCTTTGACATA
ATAAGTGGTATTGTGGTAGACTAACATTTTTTTATATATTTTCCATTGAATGCTCTTCTCCCCCATTAAGCTTGTTCAAATTTC
TATCCATTAAAAGCAGCCTCCTTTAAGTAGACTTTTTCATCTTAGTAATAGGAAATGAAAAGTCCCATTCATAATGACATTTG
GAAACTATTACTTTTTGATTTGGAGATTAAGATTATCTTTTAAATGTTTTCTTCTTCAAACATTTCAAATAGAACGCAATTCC
CTTATAACATTTATATTTTTGGATAAGAAAATGGACAATAATAAAATAAGATGTGTGTTGTTAATGCTATTCTAGCTTTCTGG
AAGCTCAAATCTATGAATTGTTTCAGATTTGATGTTTATATAGTTCATTTGTTTTTTTTATTTTAGGCATTTGGTTGAATACA
TTGGGTTGTTCATTTCTGGTGAGCATGGCTTCTCTTGTTTGTCTGATTATCCTGCCTGTAATTTTTGGTAAGTAATTTTTTGT
CATTTTGTACAATACAAATTATTTATTTCTCAATAGCAAATGCTTATCTACAGAATACGAAATTGAATACTCAGGTTTATTCT
CCTATTTCAGTACAAGGGAAACCATCAAAGGTTGTTGTTGATTCATTGGCTTTATTTGGAAATCGTGAGTGCCAGCACAATG
CTAAGGTAGTATTTTTTTTTTAATGAATCTTGAGATTTTTGTCAGGGTTGGAATCAAACCCCCCAAGGTATATGACTTGAGAT
TAATCTTTCTTAAAAGGAAAAAAGTACTAAATATATATGTTTCTCATATATAAGGGTGTTCGTCTTTATGGTATAAGGATTTC
TAGTTATTTTTTCATAATAATCATTTCATTTATTTCTTTTTTCTTTATGATTTTGATAGATCACTTAATATATGTAACTTTTGTG
GATTTTCTTGAATAAACTTGTCACTGAGGAGGCTTTTGTTCCTATTGCTCCTAGCAACATGTTTTTCTGACCCATAAGTTGGT
```

-continued

```
GAAATATAAATGGCCTATAATGATTTGCCAATCTCAAATGCTTCTAGTGCACTGGCTATTCTCAATTTTTTTGGATAATTATT
AGTACATGAAAAGAATAGACAAAAATAATGGAATTTCTTTTGGCATAATAAGGGGGAATTGTCATAAATCCATAAAAGAAT
ATTGTCTGGTTATGTTGAATTGCTCTTTTTTTCTTTCGTGTTGTGTTGTTTTTACTTGTTAACTTGTTATTGAGTTTTTTTTTT
TTTTTTTTGCTGTGTTGTATGAATGAGATCAATGCATGCTATGAGAGATCGGATTGTTATTATTTTTATTGGTGTGTTCAGAA
ACAACAATATTTATCAAGGTACCAAAGTATTTTTTTACCAAATTAGAAATTAACAAAGTAATTGTGATAATAGTCATTCACA
TTTATTGGGATTGTTTACAATTGTCTATTGGTTGAATCATTATTTGTAGTAAATATTAGATAACACAAGTATTTTAATATATA
GCTTCAAAAGGTACAAGTGGAAGTGCCAAATTGTTGGAAAGGCTGGTATTTGTATTATTATTGGCTCCCATTTGCTCCTTTG
ATTATAAGCACATGCAATGCCTTAATTAGCTTAATTAATTATCATAATTAATGAATTAATCTAGTTTCTTTTGTCGTGAACAT
AAATGATATTTTGTGTAATTATAGCTTCTCTTAATTAAAATGTAGGTTGTTGTATTGAAATGGTAGAAAATTCCTATGGATTG
ATTCTTTGATGATATTGTTCTTGTCAAAGCTGTAAACATACATTTAACAATACTTTTTTCCCCATTTATAAAATAAGTTACCT
AAATTATTACCATGTTCATTCAAAATAATTTATTGGGTTAAGCATTTATGTTTATCTTCAAAAAAACTGTGGTACATGCTCTT
ATCTTATGTTTAGGAGATAGTATATAAATTGTTAAATAGTTCACTAAATTTAAATTTAAATAGTTCACTCTACCTAATTAGTC
AGATGTATTGTAGTACTGTTAACATTAAATTGTCTTAGAGTACATAATAAATAAAAAAGACAACAATTACATGATCATTTTC
TGTCTTAGTTTCTTTCACAAAATTCGTTGGCCTTTTTAATTTTTCTTTTTAAAAAAAGACATTCTAAGATGGAGAAAACCATC
TTAGAAAGTCTACCTTTTAAGACGGTTTTTTAGGAAATCATCTTAGAATCCTCAATTTTTTTATTTAAAAAAGACATTTCTA
AGACGGTTTTCCCAAAAACTGTCTTAGAATCCTCATTTTTTTTAATTTTTTCTCAAAAAAAATAAAACATTCTAAGACGGTTT
TCACGTAAAAACAATCTTAGAATCTTCAATTTTTTTTTAAAAAAAAATACATTCTAAGACTGTTTTCACGTGAAAATTGTCT
TAGAAAGTTATGCTTCTAAGACGGTTAAGGAACCGTCATGGAAAGTGTTGACTTTTTATGACATTAACTTTAAAGAAGGTTC
AAAACCGTCGTTGTATGTCTCAAATAACTATCACCAAAGAGGCTTTTCTAGTAATGGAATAACAAATAGTCATATAAAAAC
AAACCACACCTCAATTGTGACTTCCCCAACACCAGAAAGGGTTTGGGCTCTTCAAACGAACAAATTGTAGCTTTCATCCAC
TCCAAGTTGAAGCTGCAACACAAGTTCCCAATCTCAAAATCAAAACTTCTTGAAAACCCATAAAAGGAAAAACAAAAAAA
AAACAAAATTTAAAAAGAAAAGAGCCCACCTCCTCACTGTATAAGTATATATTGGCCAATGGTAGATGTGGATTGGAGGAT
GATCGGTCTAAACCCGACCCATATAGCCGATTTAAGTCGGTTATTGGCCCAAGCAACAACAGCCCCGTCTGTCCTGATCTG
TAACGATGTCGTCTCATTCACTTCCTTAGCAAACAAGGTCATAAACCACCTTCGCAACTCAAGCATACATGTGCAGCATGGT
CTCTCTGACGTGGAGTTTACACGTGTCCAGGCCGAGTTTGGGTTCATGTTCCCGTTGAACCTCCATGTTGTCCTAACCGCCA
GTCTTCCCATCGGTTCGCGATTCCATGACTGACACTTTGGTGGCGCGCGACTGCACCTTTCTGCGTTGTTGGACCTTCTGATC
GCGGTGATTTTGTTCTAGATCGTGAAAAATGTGTTGTGGTCGAAGTCGTGGGGTCCACGGACGTGCAAGCCGGAGAAGGTG
TTCTGAGTGGTGTAAAACACATTGAAGAGTGCTGCTACTGATTCCAATCTTCAACCATTGCTACATTTCTTCCAATCCCTCA
GTCGCTGGAAACCCTAAAAAAATTGAATTGTATGGGTTATTGTGACAAAATCAAAGAAGAGGGGGAGTTGGAGAGTGAGA
GGGACATTGAGAAAAGACTAGAGGGAGAGACATTAAAAACACACTCACTTCTAAGATGGTTTTTACAAAATCATCTTAGAA
TGAAAACCTTTTAAGATGATTTTTGCGAAACCATCGTGGAATGATAGTTTTCAAAACTGTCTTTGTTGAAAAACCTCATATTT
ACAAAATTTTCACTTTCTGACTTTCTAAGACGGTTTTTGGGGACCTTCGTCAAAGGTGCATCATAAAAAACTATTTTTTTAGT
AGTGCCTTTTTTTTCGCTGATATCTTTGTCATTCATTATATATGGTCTTGATGGTGGTGACATTTTTTTTTATCTTGATCTTTGT
TGTCAACAAAAGTTTTTTCTTCACTGCTTAAATGACTAACCTATGCATGTTCGACCAATGTTTCACTAACTTTCTGGTTATGA
ACACCACAGACAACAAAATGTTTCCAACCAACTTGTTTGACAAACTTCCCTTTTAATTTAAATGAACAACCACATTTTTTG
TTCTAGTACTCTTGCAAACTAACTTATCCTTATCTTGCTTGTACTTTCCTTCATTTTCACTACCCACTACAACATAAATTTTCC
TTCCATTTTCTGACCTATGAATGACAAGAATAAATCGAAGACTTTTCCACAAATCTCAAACCCAACCGAACAAATTGTATCA
ATTTTCAAAAACCTAAAAAATAAAATATTTTTCTTCACTTAAGCAACATACACATACATAAATATAAAATCAATCGACAACT
AATCTACATATCTCATCAATTGTGAAATGATTGGAAAAGTTAGGGTAATCAGGTTAGGGAGAGGTCAATGTCCAACCCATT
GTCAGGATCTGTAGGCATTTTATCTGATTGATCTGCAAACATTTTATTTGATTGATCTGCAAGCATTTCATTTGATAGATTGA
```

-continued

```
GACAGTAAAAAACAATTTGACTATCATCATACATGTTTCCAAAACCCTAAGGCATTGTAACTTCATCAGAAAAGATGTATTT
CAATCCATGTATACACTGCAAAGAACCATTCATGAAAAATCAAAATTACAAAAAATAACACATAATAGAATCATGATTTTG
TTGTGTATTTGAAATTTGACACAAAACAAAATCAAGATTTCATTGTTACTAAAATTTCAGATACTAAACTTTTATCATTAGC
ATTTTCAAATACAACAACTTTTTTATATATACAAAATAATTGTATATCAAATAATTTTATCCACATAAATTGCCGATTTAAAA
ATTATTAAAATACTTTTATTATCTAAACATATAATCTCGTTATGTGTACATAATAAATGTATGATAAAATCTTCATATGTAAC
AACAATCTAATTAAGATAATCTCCTATTTGAAAAATAATTTCTTCACATATCAAATTTTAACTTTTTATATATAAAAATAAAT
AAATAATTTTTTTTATTGATTTGTTTCTTTGTACTGTAAGTAGTTATTTTGTTTTTAGTATTGGGTCGGGTCCAATGATGAGTG
GTGAACTCCCTTGATTAAGTGCAGCATTCCTTGACGGGCAAGAAACAGTATAAAAGGGTCTGCATGATTTTGATGTTTTGAT
CTCTCTCCAACCCTAACACCAACTTTTTTAATTAATTTTGTTGTTGTGAATTCCATGGAAGCCTCCGAAGACCAAACAGATA
TCATGGAGCCGCATCTTGATTATTATACCCTGGAAGAAGATTTCTCAACAAGTTTATTTGAACTTGATGTTTTTCCACATCCT
AAAGATCCCTAAGAATCTCACATAACTTTCTCCGAACTTGTTGATTTTCTCAACTCCGCCTCCAATCGTCAAGAGGGTTCTC
CTCACCATCACTAAATAAGTCCAAAATGGTACTGTTTTTCGTCGACTAATAATGCCTTTTGTTTAAATATTTTGTGCTCTTGC
AGGATTTCACATTTTGTTTATCACGGGTTCTTACATGGATACTATGGTGAGCAACTACGGTGTTGTCCTTGCTCTAGTGAAGC
ATCTTTGGGCGCTGCCACACACTACTACAAAAAATAGCTTTTACATCGGTTGATTTGGGCATTCTACGATGATTTTTAATTAT
TATCTTAGAAAGTCTTCACTTTTTACGACGGTTCCACAGAAAATCATCTTAAAAAATATCATTCTAAGACGGTTTTTAGCTA
AAAACCGTCTTAGAATGGTATATTGTCTTAGAATGTATTTTTTTAAAAAAATGAAATATATTGAGGATTCTAAGACGGTTTT
TTTCAAAAAAAAAAATCATCTTAGAATGTCTCTACATTCTAAGACGGTTCTCTTAAAAACTGTCTTAGAATGTATTTTTGTT
TAAAAAAATATTTTAAGGATTCTAAGACAGTTATTTAGAGAATTATCTTAGAATGTGTTTCTTTTTTTAAAAAAAAAAAATCT
AAAATTTCATACATTTTTTACCATCAATCTTAGATTTCTATTCTAACCACATGTTATTTCATATACTTTGCATGCTAATAGAT
ACGGAAAAAAAGGAAAAAAAAGGAACAAAAAATATTGTCCCCTAAAACAAGCATAATAGGAAGTCTTAAACAATGTAG
TTATAATTATGTATGCATGTTATCTAATGAAATTGTATCAAATATAAATAAGCAAGGTAGAAGTTATAATTTGTAATTTCCTT
CTAGGTGGAACTTCACTCACGTGCACTAAAAGTGATTAGAAATAGTTTTTGTTTTGAGTTAAAAAATTTATATTAATTTTTAT
AGCAATTTTTTTAGTTTAAAAGCATCTAAATATAAATTATTTTACTTGAAAATAAATTTTAATTAAAATCTATTTTACAAACA
CTCATCCAAACATAAAATATTATTAGTAAAAAAATAAGATGTTCTTAGACGTAGTGTTGTATTATGTATGATTTTTAAATTAC
ATAATTAATATAAAAATTAATAAATTTATCATGAAAACTTATTATAAAATAACTATATAATTATTTTATATTATTAATGTGTT
AACTATTTTACCTTCATATTATTGTACTATCTTTCATTTAATATATTATGTGGTAAAAAATGTTAAAGTATTTTATTCTTCT
TTATTAGTTGAAAATATAATTAAAAAATAATATACAAATATCATTAATGTTGACTATTATTTGCATATATACCACTGCAAAG
TTGGACAAGACACACGACACACTATAATGCATGTGTATCATATTATACATGAATAGCTATTCACCTAATATATATTGAC
GCGATGCATTACTACTAACTAGGTACCATATCAAGCAAGAGTTGACCTCTCTACGACCAGACCTCTATATAATTTTGTAACA
ATGTTTCCCTTTCCTACACTCCAAGCGAAACTTTGGATTCCATCAGTTTTAAGGAATCAGGTATCTTAGTCCGAAGCTCAAG
TATCAAAATACTTAAATCTATTTAAGGAATTAATTTCTTTCGATATATATTTTTGATTTAAATACATTTTTCATTCTTGCAATT
TAACTTTTTTTTATTTTTGTTCTTGTAATTTTCTTTTCGTTTTACTGTGTTGCATAATAGATACAATACCAGAATATGTGATTAT
GCAACTACATTGTAAGTATGAGCAACTAAAGGCGTACCCGTTGTGCAGGGTTTAATCTCATCTTGACTTAGGCATATAGGTT
TCGTAGGACCTGCTTCATCTCCACCTGGTAATAAAATCCAGCTATAAATAAGAGAAGGAAGGACACAACAGTTATGTGATA
TATAGATATGGAATGCAATATCCTAAGGATGATATTCGTTCATATTGGGTCATAGACATACTCCTTATTAATGGCACGCTCA
ATGCATTGTTGTCTTCAAACCATCTGTGTAACTGGTCGTTTGCCTTCATAAAAAATCAAGACCAATATCTAGATCAAAAGAA
AATCTAAATTTTTCAACTATTAAAAATAATTTAGAAACTAGCTAAGAAAAATTTACTTTTAATTCAACAAAACTAGCTTATC
ACTTTTTAGTTACTAGCTAAGTTTTTAACTTTCAACTAAATTTTAAACTTTTAGTTACTTTTACCCAAAATAATCATATAATAT
AAACTAATGTCAATTTCCATATAATTCAATGATGGTTGGTTTTCTTAATTAAATGTGAAGTTTATATTTGCCTATTCTATAAA
TCAAGTAGCAATGGAAATAACCATAATGAATGTCAACCTAGCACAAAGAAAATCAAGACAGAAGGGAAATTATATCAAAC
```

-continued

```
ATAAGATGCACTCCCCCTCCCGGTATTACAGGCATGAGAAAGTGAAGAAGAATTATTTAGTAAATTGGTAGAAAAACTAAA
ACAAAAAAAAATATTTGAAGGCTTTAGAGTTGTGTCGTGAACAAAAGGAAGTTGCTAAGTGAAGGACTTACTTTAAAGAGT
AAAGTGATGAGTTATTTGATTGAAAAAATCAATTGTCAGATCATGATTAAATGCATACAAATGTTTAATAAAATATGTAGCT
ATTTAAATCTCTCAAGTCTCAACCTTTGATTTTCTAATCAATGGGTATAACTTTCACTTTAGTCTCTAAAGGAGTAAAATCAG
AACAAGGCAATCTGGGTTGGACCCACAGAATTTGAGATGAGCAAGGGGAAGAGGAAAAACTAGCATCATTGATCTGAACA
AGGGAGAGGTGGCACGTTAGCTATAAACAAAAATTGTAGCAACAAGAGACGAGATGCTCAGGGAATGACAACTCTTTCTC
ATGATCTAAATTATCCCAAATCATTTTGTCTTTCCATTGCATAGTCCATTTTATTTCACATACCTCTCTATTTTCTTCCTATTT
TTATCCTTGTTCAAAGGATGTTGTGATAAATTAACGTTAATATATAATTACTCTACTTCAAAAACATAAAAAAAAAGAGTCT
AAATCGCACATTCCTGAACAGACATGTTCACCACTTTATTTTCAAAAAAGAAAAGAAAAGAGAGTAGCCAAAAACAAGA
AAGAATGACATGCAATGGTAGCATAATTAATTAGCAGCTATGGAAATCCCTCTTTAAGCACTTAATTTTGCTAGCTTAAATT
ATACGTTAGAGAATCAACCAAAAAAAAACTCGCCTTAGGAACACCAACATACAGATCTTCTCCCTCTGGGTGGTTGATGAT
GACTCCATGTCTAGGATTCAACTCGTTGGTAGCTATGTCATTGTACATAAACACCACTATGTTCTCTTCTTTTAGTCCACCTT
TTATCAGCAACTAGTATGCATGGCACACATCTGCTTGTTTATAATTTAATTCAATTCATCACAACATCCATAAACAAACCA
TTAATGAAAAACACATAGCAACTCAAAACATAAAACTAATTAATTAATTTTAGAAAATAAATAAAAGGAGACACCTTGGTC
TTTAAACCAATCCAAAAAAATAAAAACACCAAAACCAAATTAACTTACTTGATGCCTGTAGTTTCCATAGCCGTTTGAACT
AGCCATGAGAACCGCCCATCGTGTTCCCACTTCATCCGAGTCAGCATCCACCGGTTCAGTCGGTAACTTTATGACTGAGTCC
CACTCCTTACGGTTCAGCCTCGCGGCTGCACCGTGCACTCTCACGAGCACCACCATCATCCATAATAGGACATTGTACCAC
GTCGTTTTGCTTATAATGGAGCGATGAAGCGCCATATATATCAGCTGAGAAAAACAAATGTGACACCCTCTACCCTCACAA
ATAACGAATAAAAGGAAATAAAATCATGCGGATTTTTTTTAAACACATTGACTTTAAATTGATTTCAAAAGATAAAGGGTT
CACATTCACTTAATGAAAACATAGTAGAAATTGTTCGAATAAAAACAACAAAGTTATCCCGGCTCAAAACAAGGTCGTCCA
TGCTGAATGAATAATAATAATAAAAAAACTAAAACAGAAAACATAACACAACTATATCGTTTACGGAAAATATAACATGCG
AAGTAAAATCCTATGCCCCAATGTCACACTTATCAGAGCATGTCTCTATCACAGACTAAGTCTCTCCGGCTCTAACATGGAA
TTTATCATGTGATGGCTCACCTGAACAAATGACAATCAGCCCAAACACAAACACACTAGGAATGAGTTATCACATTCAT
ATATAATAAATATTAGAGCATGTAAAACATATAATACTTAAAGCTGAATTTATATAATTAACATCACTTCCCAAAATCACA
CACATTTTGCACATCCATTCAAGTTCATCCACTCCAGAAAATAACATCAAACCACAATTGTTAACTCAATGAAAGTCAAAC
ACATGCATTATGCAACAAATACTCTAGACTTAAGCCTACATGCAATGTGGTACCATTTTTCAGTGAAAAACCTCGTTGGGCG
CCTAAGAGTACATGACAGGACATGCCTCACAATGGGTAAGTTAGGTCACTTTCACTAAGTGAAATCATAGGGAGACCAGTC
AGGATCACGTTGTTTTGCGAGAATGCTCCAACCATGTGGGAGCGGCACAGGCTTAAAGGAGCACTCAAATCGGATGACCCC
CAAGGCCTACACTCCGAAGAGTTCGTCAGGGCCTCTCCCTCCTGATTCAGGTCTAACCCAAAAAAAAATTTGAACACATAG
ACTCTACCTATGAATTATGCAATGCACACAACTACTCAATTGTGTGTGTGTATATATATATATATATATATATATATATAT
ATATATGTATGTATGTATATTTTAAAATATATTTTAACTCAGTGCACCTCAAGTGATTAAACTCGTCGGGTTCCCACAGTGG
ATCTCATCACAACTCTTTGCGCATTAACTCGTCGCCCTTAAAGGGTCTTACAGTTGTGTGATTACATAATTCATGGCTCACA
ACTCAAAACATAGAACATCTCAACAATTATGTAATTCACAATCCATTATGTACTAAATGATTATCACTTACACACAGTCTCA
ACCACAATTTCATAATAAAATAATTTATCGCATCTCACGCATCCTACACATATCATTCAATAGTAACATTTACTTGACACAA
TAAAAATATAGATTAACCGAATATATTAATTCAACAAAATAAATAAATAAAAATATCTACAACAATTAATTTGAGATGTGG
CAAAAATAATTATGATTAAGCAATAATTTTACAAAAGTATTTAATTTATTATTATACATATATAACTAAAAAAATAAAAAAA
TAATAATGTCACAAAATATTTAATTTATTTCTCCAGAGCAGTAAAATAATACATTCACAACAACATTTAATTTATTATATATA
TATATATATATATTAAAAGCAAAAACCATGTGTTACAAGTATAATATCTTTAATGATAAACGTATTAAATATATTATTACTG
CACCTTGAAGGGAATATTTAACGGCTGAAATTCATTTATAAGAAATATTAACGTATGCATTTTTTTCCACCTTAAAAAGAAT
GTTTATGTTGTAATTTGTTGATCAATTTAATATGTAGAAAACAGTAACATATCAAGCATATTTGTTGCGCCCTAACGTATCAA
```

-continued

```
AGTTTTCTGTTGTAATTTTGTTAGACTATCAAATTAGTTTGTTAACAAATTTGTCAAGAAAAATTAAAAATTTGAAATTAAAA
GGTGCAGTCAAACCATTAATTTAACAAACATATTTTTGAGACTACAAATATTTTATACTAAAATCAATCCCTAGTCAAGTCA
AATAGGACAACTATAAACAATGTATAACTAATTTGTTGGTTTGCATTTTTTTTTTTGTTCTTTTTTTCAACAAGTATTACATA
CACGTCTTACACTATTTTCAAAAGAGTTGTGGCAAATTTAAAGCAACGATTCCCAAACAGGGAAAACAACTCTTATTTCAAT
TGAAAACTTCCAAATATAATAGTAGGGAAAAAGATGACAATAAATTGTAGTTCATTACAAACAATAGACAATACAATTATT
TGGGTCAAATTTTTCATTCCAATGATAACAATTCACTAACACATTCAAAAAATAAAAATAAATCACAAGCGCAAAACAACG
AAAATCATACACGTTAATATACAACAAGAAATCAAGTAATAACAATTGAAAATTAAAAAAATCTAATATACACCAAGAAA
ATATCATATCAATATATACTAACAGGATCATAGAATTTCATAACAATAGATATTACACTCAATTTAGCGTAAGAATTATTCA
ATTTGAAAGAATCATGAATTAACATTTTATAAAAACAACCCAAAATACCCCAAAATTGATCCTCTAGAAATCCTTATACATG
TTCTTCTAATCCTCAAGCGTGAGTAACTCATCCCTTACCTCGATGTAGTCGCTCAAACGTTCTCCATTAGCAATTGTGGCAT
CTCTGGTGCTCTCTAGAGCTCCTCATCTGGTTGTTCTGATAGGGTTCTTGTGCGTCAGAAAAAGAAGAAAGAAATAGAAGTG
TTTTATAAAAGCTGCTCTAGGTTAACATTTGGTTTATATAGTGGAAAATTATGACCTAATTACTTTTACTTATTTATTTACTA
ATTTATTAATTTTATTTTATAGGAAAACTTAAAAAAAAAAAAGCATGGTTGTTACAACAAACTCACTCAGTCACTCACACAC
ACAGGAGTAGGTGTTGGGTTGACAAAGCAGAGGAGTGAAGAAAGGGTTTATTAATCAAAATTGACTCAGTTAAAGACAATA
TGTCATGCAAATTTAGAGCGCGACACATTCAAAATCAAAACAGTTTGGGAAAAATGATGACAAATTCAAAACCATTTCTTA
AAATGAACTTTTATACTATGAATAAATTAATCAAAAACAATACTTTCCAACTAAACAATGACTTATTGTCATTTCTCTACAG
CTTCCAAGAGATGAAAAAGAACCACGACAGAAGAAACAAATTAGGGATGTTAGTTACCAGAGAGCTGAGTGGTTAGATC
TACTAGAAAAGATTTAACACCCTTATCTTCCGTTAGCAACATGGGGAGGCCATATTTCTTAACTTTCACAAAGCTTTCTTCT
GGATAAACTCCACGGTTGTAGAGATTGTTGATCAAATTCCCATATTAAAATAAGGCCCAAAATAAATTAAAAAATGCAGGA
TACAAGGATCAAACTTGATGGCAGCATATCCTAATTTGAAAAAATCACCAAAAAAAAGATCAGGCAAAAGTTCACAAAAA
ATACACAGGTATGCAAAAATCAAAGAAATCGGAGGAAAGCGAGAAAAGAGAAAAATGATATGAATACCGAAGAACTCACT
AACGATTGTGCGGAACCGCAAATAGTGATTATGTCTTTGGCAACTGTTCTTGCGGCCATGTCTTTTCTTTGGAGTCTAATTT
TGAGCAACGAACGTTTAAGTTTTCGACATAGGGTTGGGTGGAGCTTGTTCGCACGATGAAGCAAAATGGGAAAGCTTTTGT
TTCGATTGTGGGAACACTGGTAAGCGAAATGAACTGGTTTTGAAAAGGGGAAAATAATGGCACTTAATTAGGGATTGGAAG
TGGAAAGAATAAAACTTGATAGAGAAGCACCATATCCACTAAAAAAGGGGTATCGATGTTGTAAGAAGTTGGTGGGTCTTT
CTACAAGTCCTTGAGCTCCTTGAGGATGCGCTTTGAAGCCATGGGAGGGACGATACGCATTCAGATCTGAAAGGGAAAGAG
GGATCTGGATATCAGGTTTTGGTTGTGCAGCACCAAAAACCACAATCAGTGAAAGAGGGATTTGAAAGGGAAAGAGGGAA
AGAGTGAGAGTGAGAGGTCTCTGTGGCTCTCGCTTATGGAGAGTGAAAGAGCGAGTGAGGGAGAGCAAATGTTTAAGCTCT
CAAGAGGGAGATATAAAAATTAAAAACATATTCTCTTCGAAGACGGTTTTTTAAGACGGTTTTTGCAAAACCGTTGTGGAA
GGGTAGTTTCTAAGATCCCATATTTACAAAATTGTCATTGCGTTACATACTAAGATGGTTCCTTCTTGAGGAACCGTCATCG
TTTTACTATCGTAAAAAATGCTTTTTCGAGTAGTGACAGACCATTGAGAAGCATGAGGTGGAGAACAAATATGCACACATC
CTTGTAATTCTTGCTATTAAAGTAATTAAGTTCTACTCATCCTTTTCTCCCTAAATATCTTAGTTAATGCTATATATTATATTG
TCATTATTGAATATATAAGGGGACGAATGCATTGAAATTGCTCTTGAATGTACTATTTCTCTCACAGGACTCATCCCTAAAA
GGGATTCAAAATTATAGTGTAATAGATTATTTTATATTAATTTAGTTTACTTTTATAACTAAATTAAAATTATTATCTTATTTT
ATGTTCATTTTCTTCAAATTAAGATGTGAGGTGTGACTTAAAAAATATTATTATGTTAGTTTTTAGTTTCTTTTTTATTTATTA
TCTTTGTAAGGGCATACTGAATGAATTTTTAGCTCACTCTACAACATATCAATGTGTAATTGATATATGATCATAAACTTAA
AATATTTATTTTTTAACAAAATAAGAAACAACTAAAAATTCAAATTATAAATGAAAAACTAAGCATTAGTATATTAATAAT
GAACAAAAATATGAAATATTTAATATGAAATGATATCTTGTTGATGATAAAAAATAATGACCTAACAGAATACTTTCTTTGA
TAGACAGAACATAAAATTAAATTGTTATAAATATATAAGTAAATTAAAGTTATAAAGGATGTGATGAGTTTCTTATAGCTTT
ATTCGAAGTTATAAAACTCAACCGGAATGGAGATAGATTTAAAAAAATATAAATCAACCTTTTTAAATGTTGGGGATAGTTA
```

-continued

```
ATTTATCATCGACTCATCCCATTGTCATGTTTATAAATATTTATGTTATGTAATTATTTTATGAATAAATTAAATGATAGATG

ATAATATAAGAGTAAATTGAATAAAAACATGCAATATATATATATATATATATATATATATATATATATATATATATATATA

TATATATATATATATATATATATATGAGTCTCATTAAACCTATGTTATTTGTATAATGTAAAAAAATGTATATTTATAATC

AAACTATGTATCCACTTTTTATATATAATATATCTTTATATTTTCAAATACTTATATATAAAAGGGTACATATTATTTTTTTG

TTATCGGCCCATGAAATCTTGTGTGCATCCAATAACATGACTAGCACACATTAATTAATTAAATGAAAAAGTGAGATGGAG

AGTCTTGATAATTTTAAGGGTGATGTTTGAATAAATAATAATACACATTACTCTCCAAATTAACATATAAGTGAAGAATATG

GGTGTGTTGGATTAAATACATCAACCATACTGCGTGCATGNTACGTCTCTATGTGTTTTCTATTTGAGTGTTCAGTAGTATAT

AATAGTGCGGCCCTCTTTTATAAGAAAAGATTATGGGTGTCTNTGAATCTCTGGTACGAGGGTCCAAAAATTGTTTAAGAAT

AAAATAGTTTNCAAGCCCGTGTGTTTAC
```

Example 5

Summary

Majority of the disease resistance genes contain NB-ARC and LRR domains. N-termini of these genes carry either a coiled coil (CC) or a TIR domain conserved in Drosphila Toll and mammalian interleukin-1 receptors. Soybean Rps1-k-2 encoding *Phytophthora* resistance is a CC-NB-ARC-LRR type resistance gene. By conducting transient co-expression of reporter genes GUS, GFP and DsRed2 we have shown that over-expression of Rps1-k-2 significantly inhibit the expression of all three reporter genes. Site-directed mutagenesis experiments showed that the Rps1-k-2-mediated inhibition of reporter genes is abolished among five of the 14 mutants containing single amino acid substitutions. We have shown that both NB and ARC motifs are essential for Rps1-k-2-mediated suppression of reporter gene expression. Surprisingly, mutants were able to co-express reporter genes in significantly higher number of transformed cells than the internal vector controls. Co-transformation of individual mutants with Rps1-k-2 abolished the Rps1-k-2-mediated suppression of reporter gene expression. We conclude from these data that over-expression of Rps1-k-2 initiates a cell death pathway, for which NB and ARC motifs are essential. Results obtained in this investigation also suggest that mutants either directly interact with Rps1-k-2 or compete with Rps1-k-2 for factors necessary for the cell death pathway. Mutant rps1-k proteins also possibly compete for common factors essential for the wound-induced cell death pathway.

Introduction

An array of resistance (R) genes provides plants with protections against invading pathogens, including viruses, bacteria, fungi, nematodes and insects (Dangl and Jones, 2001). These genes however confer race-specific resistance and require the corresponding avirulence (Avr) genes in the pathogen. Upon a successful recognition, mediated directly or indirectly by avirulence (Avr) and R-gene products, a range of active defenses including rapid and localized cell death, also know as hypersensitive response (HR) are initiated at the infection site. The HR is often associated with a transient burst of reactive oxygen species, ion flux, and cell wall modification, accumulation of phytoalexins and activation of defense-related genes (Hammond-Kosack and Jones, 1996).

R genes that require pathogen effector proteins for their activation are grouped into five classes (Martin et al., 2003). The most prevalent class of R genes has a central NBS domain with nucleotide binding site and a carboxy-terminal LRR domain (Ellis et al., 2000; Young, 2000). Based on the sequence similarities at the N-termini this NBS-LRR class is further divided into two groups: (i) N-termini of one group has homology to the cytoplasmic domains of the Drosphila Toll and mammalian interleukin-1 receptors (TIR-NBS-LRR); whereas, (ii) the N-termini of the other group has the potentiality to form coiled-coil structure (CC-NBS-LRR) (Pan et al., 2000). The NBS domain comprised of two sub-domains. N-terminal sub-domain NB contains kinase 1a (P-loop), kinase 2 and kinase 3a motifs (Traut, 1994); whereas, C-terminal sub-domain ARC (Apaf-1, apoptosis protease activating factor-1, R gene products and CED-4) is conserved in most plant and animal NBS-containing proteins. These motifs are commonly found in ATPase, elongation factors and G-proteins from both prokaryotes and eukaryotes that have vital functions in cell growth, cell death and defense (Aravind and Koonin, 1999; Van der Biezen and Jones, 1998).

N-termini of R gene products have been found to influence the downstream signaling (Feys and Parker, 2000). Whereas, LRR domain of the C-terminus is involved in recognition (Dodds et al., 2001; Ellis et al., 1999; Meyers et al., 1998; Noel et al., 1999). Mutational analyses also however revealed that the LRR domain plays an important role in downstream signaling (Warren et al., 1998).

Apoptosis protease activating factor-1 (Apapf1), the mammalian homologue of the nematode *Caenorhabditis elegans* CED-4, mediates caspase-9 activation and apoptosis (Hickman and Helin, 2002). Self association of Apapf1 and recruitment of procaspase-9 requires dATP/ATP hydrolysis and cytochrome c binding to Apapf1 (Hu et al., 1999). The structural relationship linking Apaf-1 and plant NBS-LRR R genes imply that NBS-LRR proteins may function as ATPase and bind ATP. Tomato 1-2 and Mi-1 proteins are shown to be functional ATP binding proteins with ATPase activity (Tameling et al., 2002). Partial or complete loss of R gene function can occur by single conserved amino acid change within the NBS domain (Axtell et al., 2001; Dinesh-Kumar and Baker, 2000; Tao et al., 2000). On the contrary, point mutations in the conserved motifs of the NBS domain resulted in gain-of-function cell death phenotype (Bendahmane et al., 2002). NBS domain plays a fundamental role in hypersensitive response development. Large-scale mutation analyses of the *Arabidopsis* RPM1 disease resistance gene revealed that mis-sense mutations were highly concentrated at the NBS domain. This suggests a critical role of this domain associated with the RPM1 activation or in the RPM1 stability (Tornero et al., 2002).

There are five functional alleles including Rps1-k at the Rps1 locus. They confer resistance against the oomycete pathogen *Phytophthora sojae* races (Schmitthenner et al., 1994). Fourteen Rps genes have been shown to confer race-specific resistance in soybean (Anderson and Buzzell, 1992; Burnham et al., 2003; Polzin et al., 1994; Schmitthenner, 1989). More than fifty races of *P. sojae* have been reported and new races are rapidly evolving (Leitz et al., 2000). A multigene family of CC-NBS-LRR type resistance genes has been recently isolated from the Rps1 locus by applying a positional cloning strategy (Gao, unpublished). Of this family, Rps1-k-2 conferring race-specific *Phytophthora* resistance was fused to the cauliflower mosaic virus 35S promoter and attempted to develop stable transgenic soybean plants. Transgenic soybean plants were successfully developed from the native Rps1-k-2 gene. Whereas, the 35S:Rps1-k-2 fusion gene caused necrosis in cotyledonary explants during *Agrobacterium*-mediated transformation process and failed to develop transgenic plants that express *Phytophthora* resistance (Narayanan, unpublished) (Zhang et al., 1999). We have shown by with the aid of reporter genes β-glucuronidase (uid A) gene (GUS), GFP or DsRed2 that over-expression of Rps1-k-2 initiates a putative cell death pathway in etiolated soybean hypocotyls (Chalfie et al., 1994; Goodin et al., 2002; Haseloff et al., 1997). Here we report the role of NB and ARC motifs in cell death pathway initiated from the overexpression of Rps1-k-2 in etiolated hypocotyls.

Results

Transient Co-Expression of Rps1-k and GUS

The plasmid containing Rps1-k-2 fused to the cauliflower mosaic virus 35S promoter (35S:Rps1-k-2) or an empty vector was transiently co-expressed with the reporter gene uidA (GUS) encoding β-glucuronidase in etiolated soybean hypocotyls (FIG. 16*a*). The level of GUS expression is presented as the average number of blue spots resulted in from successful transient expression of GUS. Average number of blue spots was significantly lower in hypocotyls co-bombarded with the 35S:Rps1-k-2 fusion gene than that in hypocotyls with vector control (FIG. 16*b*; Supplementary Table 1). Significant reduction of GUS-positive cells among hypocotyls bombarded with the 35S:Rps1-k-2 fusion gene suggests that over-expression of Rps1-k-2 inhibits the co-expression of GUS activities. At high concentrations, the Rps1-k-2 protein become presumably functional to cause cell death; and therefore, fewer cells showed GUS expression as compared to that in the vector control.

Transient Co-Expression of Rps1-k and GFP or DsRed2 Proteins

Use of the GUS reporter gene in transient co-expression experiments suggested that over-expression of the Rps1-k-2 protein resulted in the activation of a cell death pathway. A 2-reporter based reciprocal transient expression system was applied to support the observation presented in FIG. 16. In this system we co-expressed 35S:Rps1-k-2 with either green (GFP) or red fluorescence protein (DsRed2) as follows. Gold particles were coated with either (i) empty vector and the 35S promoter fused GFP (35S:GFP), (ii) empty vector and the 35S promoter fused DsRed2 (35S:DsRed2), (iii) 35S:Rps1-k-2 and 35S:GFP, or (iv) 35S:Rps1-k-2 and 35S: DsRed2. Gold particles containing empty vector and 35S: GFP were co-bombarded with gold particles containing 35S:Rps1-k-2 and 35S:DsRed2. In the reverse experiment gold particles containing empty vector and 35S:DsRed2 were co-bombarded with gold particles containing 35S: Rps1-k-2 and 35S:GFP. In the negative control, gold particles containing empty vector and 35S:GFP were co-bombarded with gold particles containing empty vector and 35S:DsRed2. When gold particles carrying empty vector and 35S:GFP were co-bombarded with gold particles containing empty vector and 35S:DsRed2 about equal number of GFP or DsRed2 positive cells were observed. About 40% of the transformed cells showed both GFP and DsRed2 expression (FIG. 17).

Transient co-expression data of Rps1-k-2 with either GFP or DsRed2 proteins in etiolated hypocotyls are presented in FIG. 18. The number of cells expressing GFP from co-transformation of both 35S:GFP and Rps1-k-2 was expressed as a ratio over the number of cells expressing DsRed2 from co-transformation of 35S:DsRed2 and the empty vector in the same hypocotyls tissues. Similarly, relative levels of DsRed2 expression from co-transformation of 35S:DsRed2 and 35S:Rps1-k-2 over GFP expression from co-transformation of 35S:GFP and the empty vector was calculated from individual hypocotyls. These two reciprocal transient co-expression experiments produced comparable results. Most importantly, co-bombardment of two kinds of gold particles, one containing a reporter gene and the empty vector to serve as an internal control, allowed us to determine the effect of Rps1-k-2 on the co-expression of the reporter fluorescence proteins. Co-expression of two reporter genes, one with Rps1-k-2 and the other with the empty vector, on the same tissue also allowed us to investigate if Rps1-k-2-induced inhibition of reporter gene expression was due to initiation of a putative cell death pathway. As compared to the number of GFP or DsRed2 positive cells in the internal controls, the number cells expressing either of the reporter genes were much lower when Rps1-k-2 was co-transformed (FIG. 18). The data obtained from these experiments support the results previously obtained from by using the GUS reporter gene (FIG. 16 and FIG. 18*d*).

Identification of Amino Acids Essential for the Rps1-k-2 Mediated Inhibition of Reporter Gene Expression Two independent co-expression studies revealed that Rps1-k-2 significantly inhibits co-expression of reporter genes (FIG. 8). Most likely overexpression of Rps1-k-2 induces cell death pathway, and thereby, reduces the number of cells expressing the reporter genes. At higher concentration the Rps1-k-2 protein undergoes conformational change to become active and initiate the cell death pathway. The NB-ARC domain is most likely the most important interacting domain involved in initiating the cell death pathway. To test this hypothesis and identify the essential amino acids necessary for this signal pathway we conducted a site-directed mutagenesis experiments. Fourteen amino acids highly conserved among resistance genes were selected based on their (i) conservation across the NBS-type R genes or (ii) importance in the expression of disease resistance (FIG. 15B and Table 1; Bendahmane et al., 2002; Dinesh-Kumar et al., 2000; Axtell et al., 2001; Pan et al. 2000; Tao, et al. 2000; Tornero et al. 2002). A PCR approach was applied in creating these mutations (see materials and methods). We conducted reciprocal transient co-expression experiments using GFP and DsRed2 reporter genes for investigating role of 14 selected amino acids on the putative cell death function encoded by Rps1-k-2. PCR-based site directed mutagenesis was conducted to develop mutants with substituted amino acids for the selected residues. Five mutants failed to inhibit the co-expression of reporter genes (FIG. 19). Surprisingly, in presence of any of the five mutants the level of reporter gene expression enhanced more than two folds than that in the empty vector control.

To eliminate the possibility of PCR-induced random mutation leading to early stop codons or frame-shifts for loss of cell death function among these five mutants, each mutant was re-mutagenized back to its wild type amino acid by applying the same PCR-based site-directed mutagenesis approach used in creating these mutants (Table 2). Results from reciprocal transient co-expression analyses of the corresponding mutants and their revertants are presented in FIG. 20A. Each of the mutants was successfully reverted to the original wild type phenotype. The other nine mutants, failed to interrupt the putative cell death pathway induced by over-expressed Rps1-k-2 protein, were confirmed by sequencing. Of the five mutants three contain mutations in the NB and two in ARC motif (FIG. 20B).

Induction of Putative Cell Death Pathway is Abolished when Rps1-k-2 is Co-Expressed with the Mutants Enhance level of reporter gene expression when co-transformed with individual mutants as compared to that of the internal control with the empty vector led us to investigate if any of the mutants can inhibit the Rps1-k-2-mediated putative cell death pathway. Reciprocal transient co-expression experiments were conducted for Rps1-k-2 in presence of any of the five rps1-k-2 mutants. In these experiments corresponding mutants were used as the internal controls. Identical results were obtained in reciprocal experiments. Each of the mutants was able to abolish the Rps1-k-2-mediated inhibition of reporter gene expression, when both Rps1-k-2 and individual mutants were co-transformed (FIG. 21). These results indicate that mutant rps1-k-2 proteins either directly interact with Rps1-k-2 or compete with the wild type Rps1-k-2 protein for factors required in initiating the putative cell death pathway.

Discussion

Transient Expression Systems

Rps1-k-2 was fused to the cauliflower mosaic virus 35S promoter and transiently co-expressed along with the reporter gene β-glucuronidase (uid A) gene (GUS) (Jefferson et al., 1987). Co-expression studies showed that the 35S:Rps1-k-2 significantly inhibited the GUS expression when compared with the vector control (FIG. 16). The results are consistent among a total of 13 replications from four independent experiments (Supplementary Table 1). Transient overexpression of 35S:Rps1-k-2 in soybean hypocotyls presumably causes conformational changes of Rps1-k-2 to its active form that initiates the programmed cell death process. Transient co-expression of GUS was carried out in cloning the *Arabidopsis* disease resistance gene RPS2 that confers resistance to bacterial pathogen *Pseudomonas syringae* carrying the avirulence gene avrRpt2. It was shown that transient complementation of a susceptible *Arabidopsis* rps2 mutant initiates hypersensitive cell death following infection with *P. syringe* and resulted in fewer GUS positive cells as compared to that in the vector control (Mindrinos et al., 1994). In our studies over-expression of Rps1-k-2 presumably resulted in cell death, and therefore, observed significantly reduced number of GUS-positive cells. Our observations are similar to that observed for human CARD12, a member of the CED4/Apaf-1 family, that induces apoptosis when expressed in Vero cells (Geddes et al., 2001).

GUS fusion protein expressed in transient assays is generally visualized in situ by histochemical staining and light microscopy (Restrepo et al., 1990; Varagona et al., 1992). One of the main drawbacks of using GUS as a reporter is that the assay is destructive and we cannot visualize gene expression in living plant cells (Mantis and Tague, 2000; Taylor, 1997). In the present investigation one problem faced with the GUS reporter gene was the inability to compare between the co-expressions of the reporter gene along with (i) Rps1-k-2 or (ii) the empty vector in the same bombarded tissues. This was achieved by using two fluorescence proteins GFP and DsRed2. GFP from the jellyfish *Aequorea Victoria* and DsRed2, a newly discovered autofluorescent protein originally isolated from the non-bioluminescent coral *Discosoma* sp., are important reporters for monitoring gene expression in plants (Chalfie et al., 1994; Goodin et al., 2002; Haseloff et al., 1997). Unlike GUS, these proteins can be localized in live plant cells by illuminating with lights of appropriate wavelengths and detecting emitted fluorescence with the aid of a fluorescent microscope. Therefore, simultaneous expression studies for both reporter genes are feasible in the same tissue sample.

Our co-expression of GUS with the 35S:Rps1-k-2 fusion gene strongly suggested that the expression of the reporter gene is highly suppressed by the over-expression of Rps1-k-2 (FIG. 16). However, we compared co-expression of the reporter gene with either Rps1-k-2 or the empty vector in separate etiolated hypocotyls; and therefore, although the results are consistent between experiments experimental variations or possible experimental artifact cannot be completely ruled out from these studies. In GFP and DsRed2 system both reporters were co-bombarded in different gold particles along with either Rps1-k-2 or the empty vector to the same etiolated hypocotyls tissues. We observed that under our experimental conditions about 40% of the times individual cells were co-transformed by DNA molecules from both types of gold particles used in co-bombardment experiments. Therefore, reporter genes were expressed in independent cells in about 60% of the times. This allowed us to study the possible effect of over-expressed Rps1-k-2 on the expression of a reporter gene in the co-transformed cells by comparing the expression levels of a reporter co-transformed with an empty vector on the same tissue samples under identical experimental conditions (FIG. 18).

Experimental Procedures

Plant Materials

Etiolated seedlings of the cultivar Williams 82 (Rps1-k) were grown for eight days in Strong-lite medium vermiculite according to Ward et al. (1989).

Plasmid Construction pPadma45, a plasmid vector for transient expression and mutational analysis was constructed as follows. The double 35S (2×35S) promoter was excised from the binary vector pTF101.1, a relative of pTF102 (Frame et al., 2002) by digestion with HincII and it was cloned into pBluescript (KS⁻) to yield the plasmid pPadma37. The fragment carrying the tobacco etch virus 5'-nontranslated region (TEV-5'-NTR) (Restrepo et al., 1990) was obtained by amplifying pTF101.1 with two primers TEVEVP2R and TEVBP1 (TEVEVP2R: 5'CAA GTG GAT TGA TGT GAT ATC TCC AC 3' (SEQ ID NO: 65); TEVBP1: 5'CGG GAT CCC GTT CGT AAA TGG TGA AAA TTT TCA G 3' (SEQ ID NO: 66)). The PCR product containing TEV-5'-NTR sequence was amplified and digested with EcoRV and BamHI and then cloned into pPadma37 in the EcoRV and BamHI cloning sites that are located at the downstream of the 2×35S promoter. The resultant plasmid was named as pPamda 38. The Rps1-k-2 gene (99-6A; Gao, unpublished) was cloned into the BamHI site of pPadma38 as a BclI fragment and the resultant construct was named as Padma39 (Gao, unpublished). pPadma39 was digested with XbaI, and then end-filled using the Klenow fragment of the E. coli DNA polymerase I. The end-filled vector was subsequently digested with SpeI and the HincII and SpeI fragment containing the 35S 3'-end fragment from pISUAgron2 was cloned into this end-filled and SpeI digested pPadma39 vector. The resultant plasmid is called pPadma40. In order to remove the original XhoI cloning site originating from the pBluescript II KS(+/−) vector, pPadma40 was digested with SalI and SstII and the SalI and SstII fragment containing the Rps1-k-2 gene was cloned into the XhoI and SstII sites of the pBluescript II KS(+/−) vector and the resultant plasmid was termed as pPadma45. This construct was used for PCR-based site-directed mutagenesis experiments. pPadma 41 without the resistance gene was constructed to use as the empty vector control.

pISUAgron2 was constructed as follows. The KpnI-PstI fragment containing 35S 3'-end fragment from pPTF102 (Frame et al., 2002) was cloned into the pUC19 vector and the resultant construct was named as pISUAgron1. The EcoRI-HindIII fragment containing the 35S 3'-end fragment from pISUAgron1 was cloned into pBluescript II KS(+/−) vector and the resultant plasmid was named as pISUAgron2. The HindIII fragment containing the GUS fragment from pTF102 (Frame et al., 2002) was cloned into pISUAgron2 in the correct orientation and the resultant plasmid was named as pISUAgron3.

pISUAgron6, a plasmid vector used in transient expression analysis was constructed as follows. pTF101.1 was modified by inserting restriction sites NruI, StuI, NcoI, MluI in between BamHI and HindIII and the new plasmid vector is named as pTF101.1m. The fragment carrying the 3'-end of the soybean VSP gene was PCR amplified from pTF101.1 using primers VSPF and VSPF (VSPF: 5'-CGC GGA TCC TCT CAA CAA TCT AGC TAG AG-3' (SEQ ID NO: 67); VSPR: 5'-CGA ATG AGC TCC CGG GAG GCC TAA GAC GTG CTC AAA TCA C-3' (SEQ ID NO: 68)). The PCR product was digested with BamHI and SacI and cloned into Padma38 as a BamHI and SacI fragment and the resultant plasmid was named as pPadma43. The HincII and SmaI fragment of Padma43 containing the soybean VSP 3'-end was then cloned into SmaI site of pTF101.1m and the resultant plasmid is termed pISUAgron5. The BclI fragment containing Rps1-k-2 used in the construction of pPadma39 was cloned into the BamHI site of pISUAgron 5 and the resultant plasmid is termed pISUAgron6.

PCR-Based Site-Directed Mutagenesis

Oligonucleotide-based site-directed mutagenesis was conducted to introduce specific mutations into Padma45 containing Rps-1-k-2. Two primers containing the desired mutation were designed for each target site for substituting amino acids (Table 1). The nucleotide change for each amino acid substitution was based on the standard genetic code and codon usage table for Glycine max (codon usage database: http://www.kazusa.or.jp/codon/). Two unique restriction sites XhoI and HpaI were utilized in carrying out the PCR-based mutagenesis (Supplementary FIG. 1). XhoI is located within TEV leader and HpaI is at the LRR region but very close to the NB-ARC domain. Two primers, one complementary to the sequence containing the XhoI site (Pd45-XhoI, 5'-gagaggacctcgagaattaattc-3') and the other complementary to the HpaI site (Pd45-HpaI, 5'-gacgcaagttaacaagattgcgc-3') were synthesized and applied in conjunction with primer pairs for individual target sites containing essential candidate amino acids considered for substitution (Supplementary FIG. 1). The PCR reactions contained (10 mM Tris (pH 8.3), 50 mM KCl, 0.05%,7 mM MgCl$_2$, 1.25 mM dNTP, 5 pmoles of both primers, 200 ng of template and 0.5 U Taq DNA polymerase (Gibco-BRL) per 100 μL final volume). PCR was performed with initial denaturation at 94° C. for 2 min, followed by 10 cycles of 30 sec at 94° C., 30 s at 55° C., and 2 min at 72° C. These PCR products were run on 0.7% low melting agarose (SeaPlaque®, GTG®, BioWhitaker Molecular Applications, USA) gel and then eluted from the gel and extracted with phenol and chloroform, and precipitated with ethanol. Purified PCR products were then used as templates for the second PCR, in which Pd45-XhoI and Pd45-HpaI primers were used. The second PCR was conducted for 20 cycles (initial cycle at 94° C. for 2 min, then 20 cycles of 30 sec at 94° C., 30 sec at 50° C. and 2 min at 72° C. and final extension of 8 min at 72° C.). The PCR products were digested with XhoI and HpaI, and then gel purified and cloned into the XhoI and HpaI sites of the plasmid vector pPadma45. During this PCR cloning process the XhoI-HpaI fragment containing the wild type NB-ARC domain of pPadama45 was replaced with the PCR generated XhoI-HpaI fragment containing mutations in the target sites (Table 1). The PCR approach applied in generating mutants was also applied for developing the revertants (Table 2).

Transient GUS Expression in Etiolated Soybean Hypocotyls

Eight day old soybean hypocotyls were placed inside Petri plates (9 cm in diameter) containing moist filter papers. Hypocotyls were then bombarded with 5 μg circular plasmid DNA coated onto 500 μg gold particles using a PDS-1000/He Biolistic Particle Delivery System (BioRad, Hercules, Calif.). Hypocotyls were bombarded at 1350 PSI Helium pressure with plasmid DNA-coated gold particles (Bio-Rad, Hercules, USA). Gold particles were coated with either (i) 5 μg of GUS plasmid and 5 μg of pISUAgron6 (Rps-1-k-2) or (ii) 5 μg of GUS plasmid and 5 μg of pISUAgron5 (Vector) according to Sanford et al. (1993). Bombarded hypocotyls were incubated at 20–22° C. for overnight in dark. Twenty-four hours after bombardment hypocotyls were infiltrated with substrate for assaying the β-glucorinidase activity encoded by the GUS gene. Following infiltration the hypocotyls were incubated at 37° C. for the overnight and then scored for GUS positive cells (blue color development) (Jefferson et al. 1987). Hypocotyls were stored in 100% (v/v) ethanol. Four independent experiments were carried out for these two kinds of gold particles. Each experiment was comprised of 2–3 replications. In each replicate, 6–8 hypocotyls were bombarded with gold particles. Average and standard errors of GUS positive cells showing blue color were calculated from observations of individual hypocotyls.

Transient Expression of GFP and DSRED2

Eight-day old soybean hypocotyls were bombarded with gold particles containing either GFP or DsRed2 reporter gene following the protocol described for transient expression of GUS in the previous section. Treatment comprising (i) 5 μg of pPadma45 (Rps1-k-2) or plasmid containing either mutant, or revertant of the Rps1-k-2 gene and (ii) 5 μg of either pGFP or pDsRed2 plasmid (FIG. 15) were coated onto gold particles. In the empty vector control 5 μg of either pGFP or pDsRed2 plasmid was coated onto gold particles along with 5 μg of pPadma41. Gold particles containing Rps1-k-2, its mutants or revertants and pGFP were mixed with gold particles containing the empty vector and pDsRed2 in equal proportions. Similarly, gold particles containing Rps1-k-2, its mutants or revertants and pDsRed2 were mixed with gold particles containing the empty vector and pGFP in equal proportions. The Petri plates were placed in a particle inflow gun chamber at a distance of 10 cm from the particle accelerator and bombarded with mixed gold particles as described for the GUS reporter gene. Bombarded hypocotyls were incubated at 20–22° C. for overnight in dark.

Epifluorescence Microscopy

Epifluorescence microscopy was conducted using a Zeiss Axioplan 2 microscope. FITC (Fluorescein isothiocyanate) filter set containing HQ 480/40X excitation and HQ 450–650 nm emission filters was used for viewing hypocotyl cells for GFP expression, whereas the TRITC (Texas red isothiocyanate) filter set consisting of HQ545/30 excitation and HQ500–700 nm emission filters was used for viewing hypocotyl cells for DsRed2 expression about 24 h following bombardment. An imaging system (Axiocam HRC) comprised of Carl Zeiss vision software attached to the fluorescence microscope was used to capture the image. The number of GFP and DsRed2 positive cells was counted for each field at the 10× ocular magnification.

In an individual hypocotyls, total number GFP positive cells from bombardment of gold particles containing pPadma45 was divided by total number of DsRed2 positive cells resulting in from co-bombarded gold particles coated with the empty vector pPadma41 and pGDR to obtain ratio a ratio. In some experiments empty vector was replaced with mutants. Each experiment was conducted at least two times and in each experiment there were two replications. In each replication four hypocotyls were bombarded. Standard errors shown at the top of each bar diagram were calculated from at least eight ratios obtained from eight individual hypocotyls.

REFERENCES

Anderson, T. R., and R. I. Buzzell. 1992. Inheritance and linkage of the Rps7 gene for resistance to *Phytophthora* rot of soybean. Plant Dis. 76:958–959.

Aravind, L., and E. V. Koonin. 1999. Fold prediction and evolutionary analysis of the POZ domain: structural and evolutionary relationship with the potassium channel tetramerization domain. J. Mol. Biol. 285:1353–1361.

Axtell, M. J., T. W. McNellis, M. B. Mudgett, C. S. Hsu, and B. J. Staskawicz. 2001. Mutational analysis of the *Arabidopsis* RPS2 disease resistance gene and the corresponding *Pseudomonas syringae* avrRpt2 avirulence gene. Mol. Plant Microbe Interact. 14:181–188.

Bendahmane, A., G. Farnham, P. Moffett, and D. C. Baulcombe. 2002. Constitutive gain-of-function mutants in a nucleotide binding site-leucine rich repeat protein encoded at the Rx locus of potato. Plant J. 32:195–204.

Burnham, K. D., A. E. Dorrance, D. M. Francis, R. J. Fioritto, and S. K. St. Martin. 2003. Rps8, a new locus in soybean for resistance to *Phytophthora sojae*. Crop Sci. 43:101–105.

Chalfie, M., Y. Tu, G. Euskirchen, W. W. Ward, and D. C. Prasher. 1994. Green fluorescent protein as a marker for gene expression. Science 263:802–805.

Dangl, J. L., and J. D. Jones. 2001. Plant pathogens and integrated defence responses to infection. Nature 411: 826–833.

Dinesh-Kumar, S. P., and B. J. Baker. 2000. Alternatively spliced N resistance gene transcripts: their possible role in tobacco mosaic virus resistance. Proc. Natl. Acad. Sci. USA 97:1908–1913.

Dodds, P., G. Lawrence, and J. Ellis. 2001. Six amino acid changes confined to the leucine-rich repeat beta-strand/beta-turn motif determine the difference between the P and P2 rust resistance specificities in flax. Plant Cell 13:163–178.

Ellis, J., P. Dodds, and T. Pryor. 2000. Structure, function and evolution of plant disease resistance genes. Curr. Opin. Plant Biol. 3:278–284.

Ellis, J. G., G. J. Lawrence, J. E. Luck, and P. N. Dodds. 1999. Identification of regions in alleles of the flax rust resistance gene L that determine differences in gene-for-gene specificity. Plant Cell 11:495–506.

Feys, B. J., and J. E. Parker. 2000. Interplay of signaling pathways in plant disease resistance. Trends Genet. 16:449–455.

Frame, B. R., H. Shou, R. K. Chikwamba, Z. Zhang, C. Xiang, T. M. Fonger, S. E. Pegg, B. Li, D. S. Nettleton, D. Pei, and K. Wang. 2002. *Agrobacterium tumefaciens*-mediated transformation of maize embryos using a standard binary vector system. Plant Physiol. 129:13–22.

Geddes, B. J., L. Wang, W. J. Huang, M. Lavellee, G. A. Manji, M. Brown, M. Jurman, J. Cao, J. Morgenstern, S. Merriam, M. A. Glucksmann, P. S. DiStefano, and J. Bertin. 2001. Human CARD12 is a novel CED4/Apaf-1 family member that induces apoptosis. Biochem. Biophys. Res. Commun. 284:77–82.

Goodin, M. M., R. G. Dietzgen, D. Schichnes, S. Ruzin, and A. O. Jackson. 2002. pGD vectors: versatile tools for the expression of green and red fluorescent protein fusions in agroinfiltrated plant leaves. Plant J. 31:375–383.

Hammond-Kosack, K. E., and J. D. G. Jones. 1996. Resistance gene-dependent plant defense responses. Plant Cell 8:1773–1791.

Haseloff, J., K. R. Siemering, D. C. Prasher, and S. Hodge. 1997. Removal of a cryptic intron and subcellular localization of green fluorescent protein are required to mark transgenic *Arabidopsis* plants brightly. Proc. Natl. Acad. Sci. USA 94:2122–2127.

Hickman, E. S., and K. Helin. 2002. The regulation of APAF1 expression during development and tumourigenesis. Apoptosis 7:167–171.

Hu, Y., M. A. Benedict, L. Ding, and G. Nunez. 1999. Role of cytochrome c and dATP/ATP hydrolysis in Apaf-1-mediated caspase-9 activation and apoptosis. EMBO J. 18:3586–3595.

Jefferson, R. A., T. A. Kavanagh, and M. W. Bevan. 1987. GUS fusions: b-glucuronidase as a sensitive and versatile gene fusion marker in higher plants. EMBO J. 6:3901–3907.

Leitz, R. A., G. L. Hartman, W. L. Pedersen, and C. D. Nickell. 2000. Races of *Phytophthora sojae* on soybean in Illinois. Plant Dis. 84:487.

Mantis, J., and B. W. Tague. 2000. Comparing the utility of b-glucuronidase and green fluorescent protein for detection of weak promoter activity in *Arabidopsis thaliana*. Plant Mol. Biol. Rep. 18:319–330.

Martin, G. B., A. J. Bogdanove, and G. Sessa. 2003. Understanding the functions of plant disease resistance proteins. Ann. Rev. Plant Biol. 54:23–61.

Meyers, B. C., K. A. Shen, P. Rohani, B. S. Gaut, and R. W. Michelmore. 1998. Receptor-like genes in the major resistance locus of lettuce are subject to divergent selection. Plant Cell 10:1833–1846.

Mindrinos, M., F. Katagiri, G. -L. Yu, and F. M. Ausubel. 1994. The *A. thaliana* disease resistance gene RPS2 encodes a protein containing a nucleotide-binding site and leucine-rich repeats. Cell 78:1089–1099.

Noel, L., T. L. Moores, E. A. van der Biezen, M. Parniske, M. J. Daniel4, J. E. Parker, and J. D. Jones. 1999. Pronounced intraspecific haplotype divergence at the RPP5 complex disease resistance locus of *Arabidopsis*. Plant Cell 11:2099–2112.

Pan, Q., J. Wendel, and R. Fluhr. 2000. Divergent evolution of plant NBS-LRR resistance gene homologues in dicot and cereal genomes. J. Mol. Evol. 50:203–213.

Polzin, K. M., L. L. Lorenzen, T. C. Olson, and R. C. Shoemaker. 1994. An unusual polymorphic locus useful for tagging Rps1 resistance alleles in soybean. Theor. Appl. Genet. 89:226–232.

Restrepo, M. A., D. D. Freed, and J. C. Carrington. 1990. Nuclear transport of plant potyviral proteins. Plant Cell 2:987–998.

Schmitthenner, A. F. 1989. *Phytophthora* rot, p. 35–38, In J. B. Sinclair and P. A. Backman, eds. Compendium of soybean diseases. APS Press, St. Paul, Minn.

Schmitthenner, A. F., M. Hobe, and R. G. Bhat. 1994. *Phytophthora sojae* races in Ohio over a 10-year interval. Plant Dis. 78:269–276.

Tameling, W. I., S. D. Elzinga, P. S. Darmin, J. H. Vossen, F. L. Takken, M. A. Haring, and B. J. Cornelissen. 2002. The tomato R gene products I-2 and MI-1 are functional ATP binding proteins with ATPase activity. Plant Cell 14:2929–2939.

Tao, Y., F. Yuan, R. T. Leister, F. M. Ausubel, and F. Katagiri. 2000. Mutational analysis of the *Arabidopsis* nucleotide binding site-leucine-rich repeat resistance gene RPS2. Plant Cell 12:2541–2554.

Taylor, C. B. 1997. Unraveling disease resistance specificities. Plant Cell:466–469.

Tornero, P., R. A. Chao, W. N. Luthin, S. A. Goff, and J. L. Dangl. 2002. Large-scale structure-function analysis of the *Arabidopsis* RPM1 disease resistance protein. Plant Cell 14:435–450.

Traut, T. W. 1994. The functions and consensus motifs of nine types of peptide segments that form different types of nucleotide-binding sites. Eur. J. Biochem. 222:9–19.

Van der Biezen, E. A., and J. D. Jones. 1998. Plant disease-resistance proteins and the gene-for-gene concept. Trends Biochem. Sci. 23:454–456.

Varagona, M., M. Purugganan, and S. Wessler. 1992. Alternative splicing induced by insertion of retrotransposons into the maize waxy gene. Plant Cell 4:811–820.

Warren, R. F., A. Henk, P. Mowery, E. Holub, and R. W. Innes. 1998. A mutation within the leucine-rich repeat domain of the *Arabidopsis* disease resistance gene RPS5 partially suppresses multiple bacterial and down mildew resistance genes. Plant Cell 10:1439–1452.

Young, N. D. 2000. The genetic architecture of resistance. Curr. Opin. Plant. Biol. 3:285–290.

Zhang, Z., A. Xing, P. Staswick, and T. Clemente. 1999. The use of glufosinate as a selective agent in *Agrobacterium*-mediated transformation of soybean. Plant Cell Tiss. Org. Cult. 56:37–46.

FIGURE LEGENDS

FIG. 15A. Diagrammatic representations of vectors used in this investigation. 35S, the Cauliflower mosaic virus 35S promoter; GUS, β-glucuronidase; Nos 3',3'-end of the nopaline synthase gene; dsRed2, red fluorescent protein, GFP, green fluorescent protein; TEV-Tobacco etch virus 5'-non-translated region; Rps1-k-2, a *Phytophthora* resistance gene. pISUAgron3, contains the 35S:GUS reporter gene in pTF101.1m vector; pGDR, contains the DsRed2 protein; pGFP, contains GFP; pISUAgron5, empty pTF101.1m-based vector that was used to develop the pISUAgron6 vector containing the 35S:Rps1-k-2 fusion gene; pPadma41, empty BlueScript-based vector that was used to develop pISUAgron6 containing the 35S:Rps1-k-2 fusion gene.

FIG. 15B. Amino acid sequence of the NB-ARC domain of Rps1-k-2. The residues that were substituted (Table 1) are shown in red bold font.

FIG. 16. Transient Co-Expression of Rps-1-k and GUS

Gold particles coated with pISUAgron3 and pISUAgron6 were bombarded onto 8-day old etiolated soybean hypocotyls. Gold particles coated with plasmid pISUAgron3 and the empty vector pISUAgron5 were bombarded separately onto etiolated hypocotyls to serve as the control. (a) Expression of GUS in the soybean hypocotyls co-transformed with the empty binary vector. (b) Number of GUS positive cells/hypocotyl. Results are mean and standard errors from four independent experiments, each of which was replicated 2–5 times (each bar diagram represents mean and standard errors from 13 replications, raw data are presented in Supplementary Table 1). R; co-transformation with pISUAgron6 with pISUAgron3, V; co-transformation of pISUAgron5 with pISUAgron3.

FIG. 17. Transient Co-Expression of Reporter Genes.

Gold particles coated with pPadma41 (empty vector) and pGFP were mixed with gold particles coated with pPadma41 and pGDR in equal amounts and co-bombarded onto 8-day old etiolated hypocotyls. Expression of GFP and DsRed2 was monitored under a Zeiss Axioplan 2 microscope 24 h following bombardment. (a–b), Epifluorescence micrographs showing the expression of both GFP and DsRed2 in the same cell. (c) Histograms representing average proportions of cells expressing both GFP and DsRed2. R (red bar), represents percentage of cells showing expression of both reporter proteins when expressed over total number of DsRed2 positive cells. G (green bar) represents percentage of cells showing expression of both reporter proteins when expressed over total number of GFP positive cells. Bar diagrams represent means and standard errors calculated from observation of about 20 independent microscopic fields of four hypocotyls. About 200 DsRed2 or GFP positive cells were counted.

FIG. 18. Rps-1-k-2 Inhibits the Expression of GFP and DsRed2.

Gold particles coated with pPadma45 and pGFP were co-bombarded with gold particles coated with pPadma41 and pGDR onto 8-day old soybean hypocotyls. In the reverse experiment gold particles coated with pPadma45 and pGDR were co-bombarded with gold particles containing pPadma41 and pGFP; and in the negative control gold particles coated with pPadma41 and pGFP were co-bombarded with gold particles coated with pPadma41 and pGDR. (a–b) Epifluorescence micrographs showing transient expression of GFP and DsRed2: (a), pPadma45 and pGFP co-bombarded with pPadma41 and pGDR and visualized for GFP. (b), The same microscopic field shown in (a) was then visualized for DsRed2 expression. Note that expression of DsRed2 but not GFP was detected in a cell of that microscopic field. (c–d), Epifluorescence micrographs showing transient expression of GFP and DsRed2: (c) pPadma45 and pGDR co-bombarded with pPadma41 and pGFP and visualized for DsRed2. (d) The same microscopic field shown in (c) was then visualized for GFP expression. Note that expression of GFP but not DsRed2 was detected in that microscopic field. (h) Results are relative transient expression of a reporter gene from co-transformation with pPadma45 (35S:Rps1-k-2) was calculated as a ratio over that of the other reporter gene co-transformed with pPadma41 (empty vector). R, red bar represents relative expression of DsRed2 (in ratio) from co-transformation with pPadma45 and pGDR over GFP expression levels from co-transformation of pGFP and pPadma41 in the same hypocotyls tissues. Note that both types gold particles were co-bombarded and same microscopic fields were evaluated for DsRed2 and GFP expression. R, green bar represents data of a similar experiment where GFP instead of DsRed2 was co-expressed with 35S:Rps1-k-2, and DsRed2 instead of GFP was co-transformed with the empty vector pPadma41 in the co-bombardment experiments. V, the vector control, in which reporter genes were co-expressed with the empty vector pPadma41. Red bar shows the relative transient expression of DsRed2 protein over GFP and likewise green bar shows the relative expression of GFP over DsRed2 in those negative control experiments. Note that both reporter proteins expressed equally when only empty vector was co-transformed with the either reporter gene in co-bombardment experiments. Results are from two different experiments, each containing two replications. Expression levels of the reporter gene with Rps1-k-2 were expressed as ratios over expression levels of the other reporter gene with the empty vector (internal control) from individual hypocotyls, and ratios calculated from 16 hypocotyls were used to calculate the mean and standard errors.

FIG. 19. Identification of amino acids necessary for Rps1-k-2-mediated putative cell death pathway. The reciprocal transient assay system described in FIGS. 3 and 4 was applied in evaluating rps1-k-2 mutants. (a-1), Epi-fluorescence micrographs of 35S:Rps1-k-2 or 35S:rps1-k-2 mutants co-expressed with DsRed2. With each construct combination gold particles coated with empty vector pPadma41 and pGFP were co-bombarded to serve as an internal control. (a–b), Rps1-k-2; (c–d), mutant G193E; (e–f), mutant V221A; (g–h), mutant D269A; (i–j), mutant L408F; (k–l), mutant F417S. (m), Relative transient expression levels (as ratios) of DsRed2, when pGDR was co-transformed with 35S:Rps1-k-2 or 14 35S:rps1-k-2 mutants, over GFP expression levels from the internal control comprising the empty vector pPadma41 and pGFP are presented. (n–y), Epi-fluorescence micrographs of 35S:Rps1-k-2 or 35S:rps1-k-2 mutants co-expressed with GFP. With each construct combination gold particles coated with empty vector pPadma41 and pGDR were co-bombarded to serve as an internal control. (n–o), Rps1-k-2; (p–q), mutant G193E; (r–s), mutant V221A; (t–u), mutant D269A; (v–w), mutant L408F; (x–y), mutant F417S. (z), Relative transient expression levels (as ratios) of GFP, when pGFP was co-transformed with 35S:Rps1-k-2 or 14 35S:rps1-k-2 mutants, over DsRed2 expression levels from the internal control comprising the empty vector pPadma41 and pGDR are presented. Two independent experiments, each containing two replications were conducted. In each replication total GFP or DsRed2 positive cells were counted from four transformed hypocotyls. Total number of positive GFP or DsRed2 cells in an individual hypocotyl was considered to calculate ratios. Bar diagrams represent means and standard errors of ratios from a total of 16 transformed hypocotyls.

FIG. 20A. Recovery of the Rps1-k-2-mediated putative cell-death phenotype among revertants. The reciprocal transient assay system described in FIGS. 3 and 4 was applied in evaluating revertants of all rps1-k-2 mutants showing loss of putative cell-death function (FIG. 5). (a–l) Epi-fluorescence micrographs of 35S:Rps1-k-2 or revertants co-expressed with GFP and vector pPadma41 co-expressed with DsRed2. (a–b), pPadma45; (c–d), revertant E193G; (e–f), revertant A221V; (g–h), revertant A269D (i–j), revertant F408L; (k–l), revertant S417F. (m), Relative transient expression levels (as ratios) of GFP, when pGFP was co-transformed with 35S:Rps1-k-2 or any of the five mutants or their respective revertants, over DsRed2 expression levels from the internal control comprising the empty vector pPadma41 and pGDR are presented. (n–y), Epi-fluorescence micrographs of 35S:Rps1-k-2 or mutants co-expressed with DsRed2 and empty vector pPadma41 with pGFP. (n–o), Rps1-k-2; (p–q), revertant E193G; (r–s), revertant A221V; (t–u), revertant A269D; (v–w), revertant F408L (x–y), revertant S417F. (z), Relative transient expression levels (as ratios) of DsRed2, when pGDR was co-transformed with 35S:Rps1-k-2 or any of the five mutants or their respective revertants, over GFP expression levels from the internal control comprising the empty vector pPadma41 and pGFP are presented. Two independent experiments, each containing two replications were conducted. In each replication total GFP or DsRed2 positive cells were counted from four transformed hypocotyls. Total number of positive cells in an individual hypocotyl was considered for calculating the ratios. Bar diagrams represent means and standard errors of ratios from a total of 16 individual hypocotyls.

FIG. 20B. Location of five essential amino acids required for the Rps1-k-2-mediated putative cell death pathway. CC, coiled-coil domain; NB-ARC, a nucleotide binding adaptor shared by APAF-1, certain R proteins and CED-4, and LRR, leucine rich regions. The gray boxes are regions between the conserved domains. Black stars represent the locations of substituted amino acids that did not alter the Rps1-k-2-mediated putative cell death function. Red stars indicate the locations of five amino acids that are essential for the expression of the Rps1-k-2-mediated putative cell death function.

FIG. 21. Rps1-k-2 mediated putative cell death pathway is suppressed by co-expression of rps1-k-2 mutants. 35S:Rps1-k-2 was coated onto gold particles with individual mutants and a reporter gene. Corresponding mutants and the other reporter gene were co-bombarded to serve as an internal control. (a–j)) Epi-fluorescence micrographs of 35S:Rps1-k-2 and any of the five mutants co-expressed with GFP. With each combination of 35S:Rps1-k-2 and mutants pPadma41 and pGDR were co-bombarded to serve as an internal control. (a–b), mutant G193E; (c–d), mutant V221A (e–f); D269A (g–h), mutant L408F; (i–j), mutant F417S. (k), Relative transient expression levels (as ratios) of GFP, when pGFP was co-transformed with 35S:Rps1-k-2 or any of the five mutants, over DsRed2 expression levels from the internal control comprised of the respective mutant and pGDR are presented. (l-u) Epi-fluorescence micrographs of 35S:Rps1-k-2 and any one of the five mutants co-expressed with DsRed2. With each combination of 35S:Rps1-k-2 and mutants pPadma41 and pGFP were co-bombarded to serve as an internal control. (l–m), mutant G193E; (n–o), mutant V221A; (p–q), mutant D269A; (r–s), mutant L408F; (t–u), mutant F417S. (v), Relative transient expression levels (as ratios) of DsRed2, when pGDR was co-transformed with 35S:Rps1-k-2 or any of the five mutants, over GFP expression levels from the internal control comprised of the respective mutant and pGFP are presented. Two independent experiments, each containing two replications were conducted. In each replication total GFP or DsRed2 positive cells were counted from four transformed hypocotyls. Total number of GFP or DsRed2 positive cells from individual hypocotyls were used to determine the ratios. Bar diagrams in (k) and (v) represent means and standard errors from a total of 16 hypocotyls.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIG. 5. Comparison of cDNA sequences with members of the candidate Rps1-k gene family. A, Structure of a LRR sequence identified from the Rps1-k locus is shown. C-C, coiled coil domain; NBS, nucleotide binding site domain; LRR, leucing rich repeat region. Two white rectangles just after TAG are introns. The black bar indicates the region used to compare sequences of two classes of genes from the Rps1-k locus with that of cDNAs isolated in this investigation. B, Comparison of candidate Rps1-k gene sequences with cDNA sequences. Rps1-k-2 and Rps1-k-3 represent two classes of identical genes isolated from the Rps1-k locus.

FIG. 8. Alignment of informative polymorphic sites among members of the Rps1-k gene family. (A) IPSs and deletions of 5'-end regions. The nucleotide sequence of Rps1-k1 is as set forth in SEQ ID NO:146 and the nucleotide sequences of Rps1-k2 and Rps1-k4 are identical as set forth in SEQ ID NO: 147. (B) IPS and deletions among ORFs. The nucleotide sequence of Rps1-k1 is as set forth in SEQ ID NO:148 and the nucleotide sequences of Rps1-k2 and Rps1-k4 are identical as set forth in SEQ ID NO: 149. (C) IPSs and deletions of 3'-end regions. The Sequence Output for DOS, Version 2.0, was used for this analysis (B. G. Spratt, University of Sussex, Brighton, UK). The nucleotide sequences of Rps1-k5 and Rps1-k3 are as set forth in SEQ ID NO:150–151 respectively. The nucleotide sequences of Rps1-k2 and Rps1-k4 are identical as set forth in SEQ ID NO: 152.

FIG. 10. Amino acid sequence comparison between Rps1-k-2 and Rps1-k-3. The predicted amino acid sequence of Rps1-k-2 is shown under domains A to F, indicating differences between the two protein sequences. The myristylation site in domain A is underlined. The coiled-coil domain is in domain B. The prediction was performed by COILS (Lupas, 1997). The conserved P loop as well as kinase-2 and kinase-3a sequences in NBS are underlined. The LRR alignment is shown in domain E. The consensus sequence in LRRs is indicated by xxLxLxx (SEQ ID NO:140) in the line above the alignment of LRRs (L can be replaced by V, F or M). The leucine-zipper-like motif is shown in bold. Domain F is the C-terminus. The red-highlighted residues are the sites that vary between Rps1-k-2 and Rps1-k-3. One LRR repeat of 21 amino acids was deleted from Rps1-k-3 and is shown by green color in Rps1-k-2.

Figure 15A:
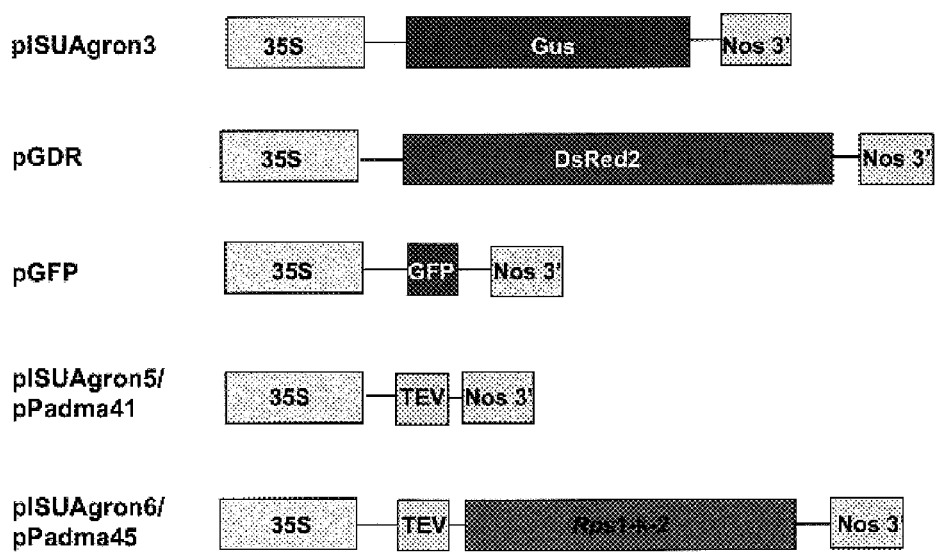
FIG. 15. Diagrammatic representations of vectors used in this investigation. 35S, the Cauliflower mosaic virus 35S promoter; GUS, β-glucuronidase; Nos 3',3'-end of the nopaline synthase gene; dsRed2, red fluorescent protein, GFP, green fluorescent protein; TEV-Tobacco etch virus 5'-non-translated region; Rps1-k-2, a Phytophthora resistance gene. pISUAgron3, contains the 35S:GUS reporter gene in pTF101.1m vector; pGDR, contains the DsRed2 protein; pGFP, contains GFP; pISUAgron5, empty pTF101.1m-based vector that was used to develop the pISUAgron6 vector containing the 35S:Rps1-k-2 fusion gene; pPadma41, empty Blue Script-based vector that was used to develop pISUAgron6 containing the 35S:Rps1-k-2 fusion gene.

Supplementary FIG. 15. Amino acid sequence of the NIB-ARC domain of Rps1-k-2. The residues that were substituted (Table 1) are shown in red bold font.

Figure 16:
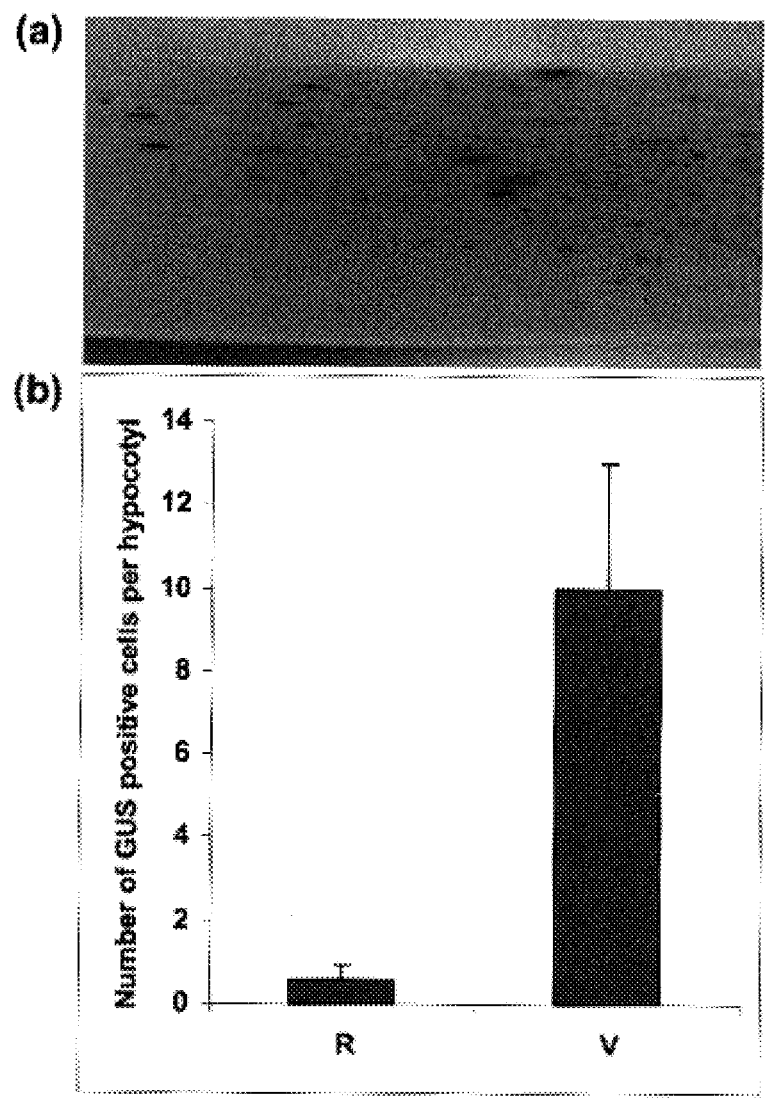

FIG. 16. Transient co-expression of Rps-1-k and GUS Gold particles coated with pISUAgron3 and pISUAgron6 were bombarded onto 8-day old etiolated soybean hypocotyls. Gold particles coated with plasmid pISUAgron3 and the empty vector pISUAgron5 were bombarded separately onto etiolated hypocotyls to serve as the control. (a) Expression of GUS in the soybean hypocotyls co-transformed with the empty binary vector. (b) Number of GUS positive cells/hypocotyl. Results are mean and standard errors from four independent experiments, each of which was replicated 2–5 times (each bar diagram represents mean and standard errors from 13 replications, raw data are presented in Supplementary Table 1). R; co-transformation with pISUA-gron6 with pISUAgron3, V; co-transformation of pISUA-gron5 with pISUAgron3.

Figure 17:
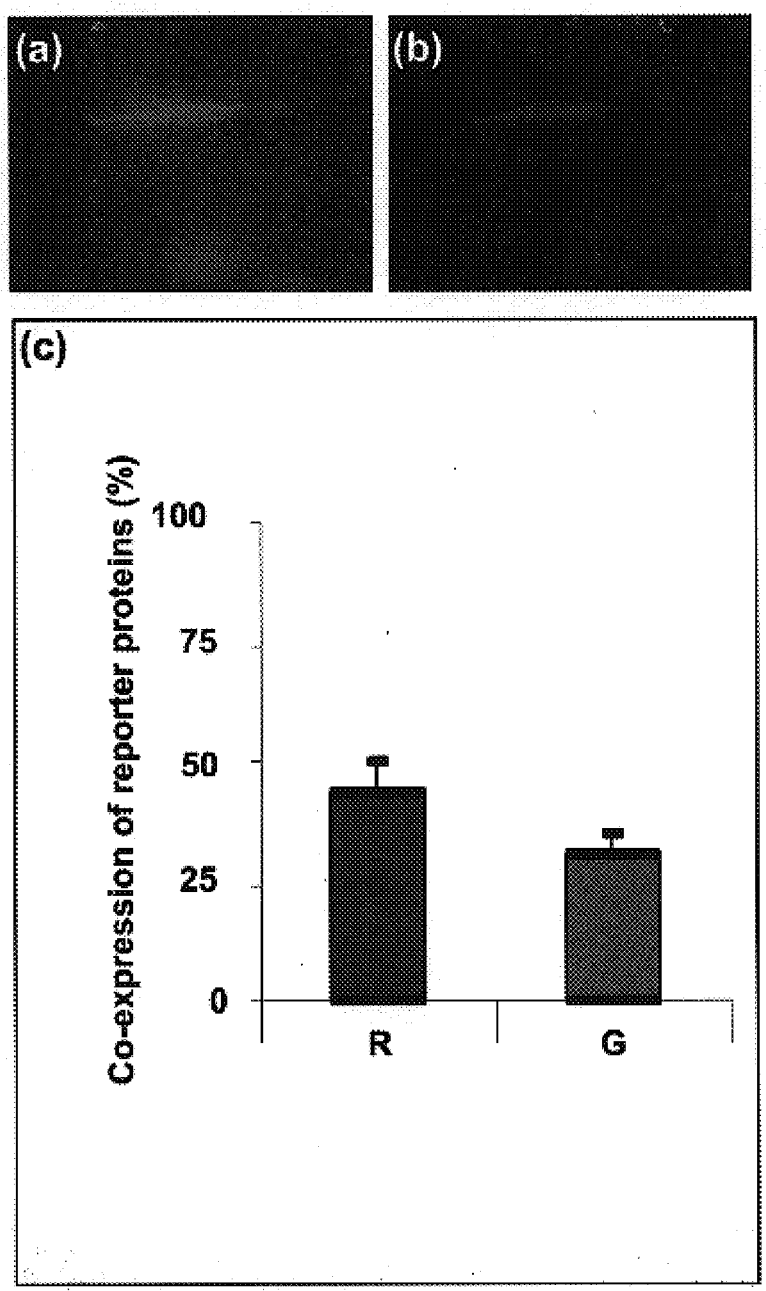

FIG. 17. Transient co-expression of reporter genes. Gold particles coated with pPadma41 (empty vector) and pGFP were mixed with gold particles coated with pPadma41 and pGDR in equal amounts and co-bombarded onto 8-day old etiolated hypocotyls. Expression of GFP and DsRed2 was monitored under a Zeiss Axioplan 2 microscope 24 h following bombardment. (a–b), Epifluorescence micrographs showing the expression of both GFP and DsRed2 in the same cell. (c) Histograms representing average proportions of cells expressing both GFP and DsRed2. R (red bar), represents percentage of cells showing expression of both reporter proteins when expressed over total number of DsRed2 positive cells. G (green bar) represents percentage of cells showing expression of both reporter proteins when expressed over total number of GFP positive cells. Bar diagrams represent means and standard errors calculated from observation of about 20 independent microscopic fields of four hypocotyls. About 200 DsRed2 or GFP positive cells were counted.

Figure 18:
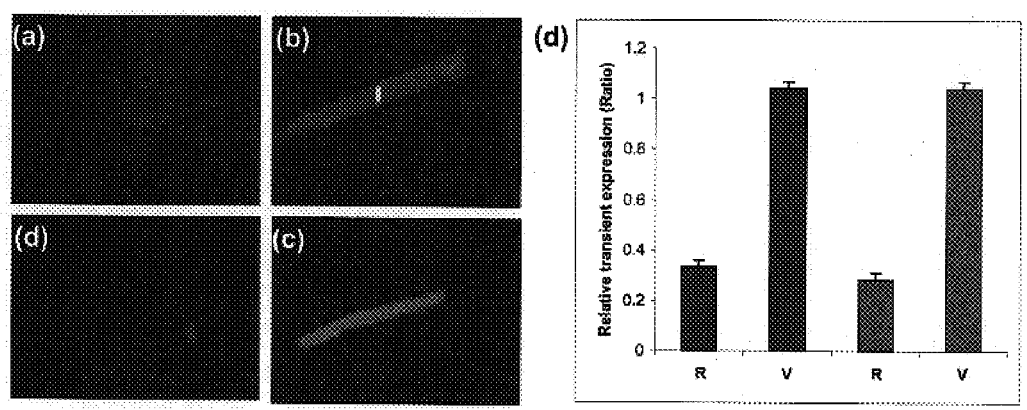

FIG. 18. Rps-1-k-2 inhibits the expression of GFP and DsRed2. Gold particles coated with pPadma45 and pGFP were co-bombarded with gold particles coated with pPadma41 and pGDR onto 8-day old soybean hypocotyls. In the reverse experiment gold particles coated with pPadma45 and pGDR were co-bombarded with gold particles containing pPadma41 and pGFP; and in the negative control gold particles coated with pPadma41 and pGFP were co-bombarded with gold particles coated with pPadma41 and pGDR. (a–b) Epifluorescence micrographs showing transient expression of GFP and DsRed2: (α), pPadma45 and pGFP co-bombarded with pPadma41 and pGDR and visualized for GFP. (b), The same microscopic field shown in (α) was then visualized for DsRed2 expression. Note that expression of DsRed2 but not GFP was detected in a cell of that microscopic field. (c–d), Epifluorescence micrographs showing transient expression of GFP and DsRed2: (c) pPadma45 and pGDR co-bombarded with pPadma41 and pGFP and visualized for DsRed2. (d) The same microscopic field shown in (c) was then visualized for GFP expression. Note that expression of GFP but not DsRed2 was detected in that microscopic field. (h) Results are relative transient expression of α reporter gene from co-transformation with pPadma45 (35S:Rps1-k-2) was calculated as α ratio over that of the other reporter gene co-transformed with pPadma41 (empty vector). R, red bar represents relative expression of DsRed2 (in ratio) from co-transformation with pPadma45 and pGDR over GFP expression levels from co-transformation of pGFP and pPadma41 in the same hypocotyls tissues. Note that both types gold particles were co-bombarded and same microscopic fields were evaluated for DsRed2 and GFP expression. R, green bar represents data of a similar experiment where GFP instead of DsRed2 was co-expressed with 35S:Rps1-k-2, and DsRed2 instead of GFP was co-transformed with the empty vector pPadma41 in the co-bombardment experiments. V, the vector control, in which reporter genes were co-expressed with the empty vector pPadma41. Red bar shows the relative transient expression of DsRed2 protein over GFP and likewise green bar shows the relative expression of GFP over DsRed2 in those negative control experiments. Note that both reporter proteins expressed equally when only empty vector was co-transformed with the either reporter gene in co-bombardment experiments. Results are from two different experiments, each containing two replications. Expression levels of the reporter gene with Rps1-k-2 were expressed as ratios over expression levels of the other reporter gene with the empty vector (internal control) from individual hypocotyls, and ratios calculated from 16 hypocotyls were used to calculate the mean and standard errors.

Figure 1:
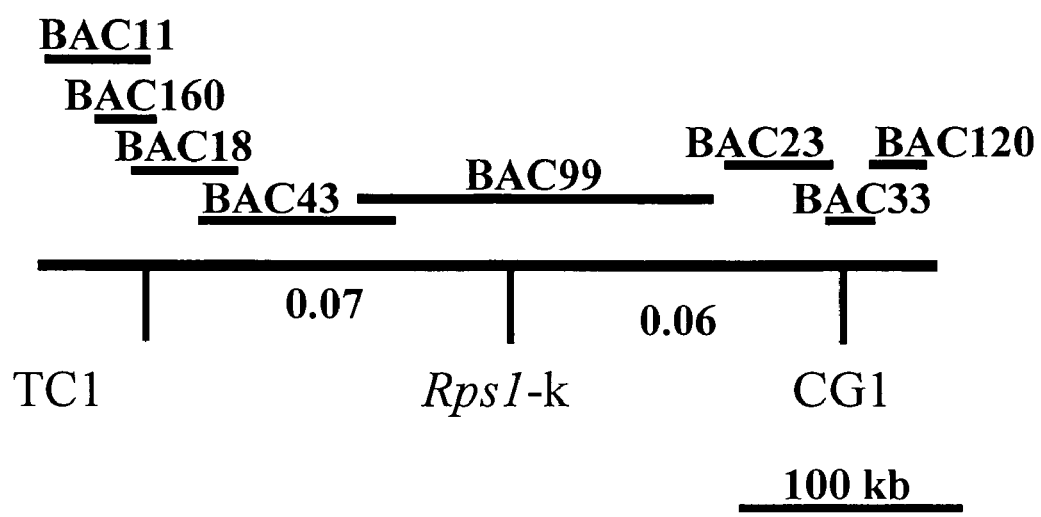
FIG. 1. A BAC contig at the Rps1-k region. Several BAC libraries carrying 24 genome equivalents were screened for AFLP markers TC1 and CG1. BAC33, BAC120 and BAC160 were obtained from a BAC library carrying five genome equivalent clones of average size ~50 kb (S. S. Salimath and M. K. Bhattacharyya, unpublished results). BAC11 and BAC23 were isolated from a separate BAC library that carries five genome equivalent clones of average size ~150 kb (Marek and Shoemaker, 1997). BAC18, 43 and 99 were isolated from a BAC library carrying 10 genome equivalent DNA clones of average size 125 kb (C. Baublite and M. K. Bhattacharyya, unpublished).
Figure 2:
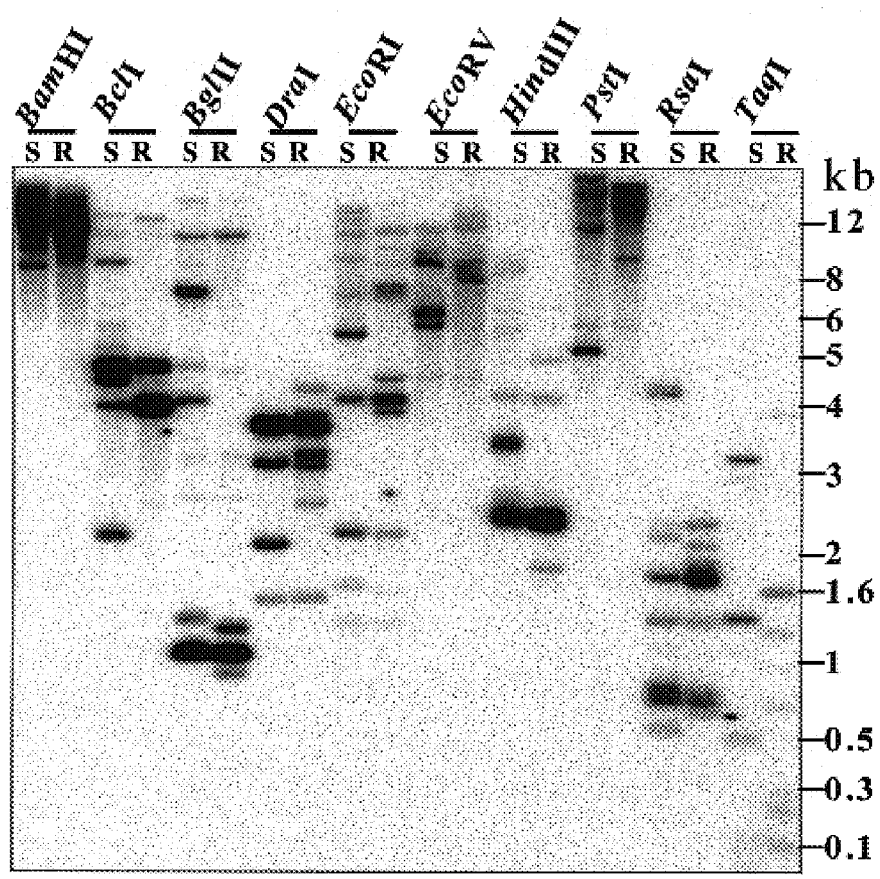
FIG. 2. LRR-160 is highly polymorphic between two near-isogenic lines (NIL) that differ for Rps1-k alleles. DNA samples from NILs Elgin (rps1-k) and Elgin 87 (Rps1-k) were digested with 10 restriction enzymes. S, Elgin; R, Elgin 87.
Figure 3:
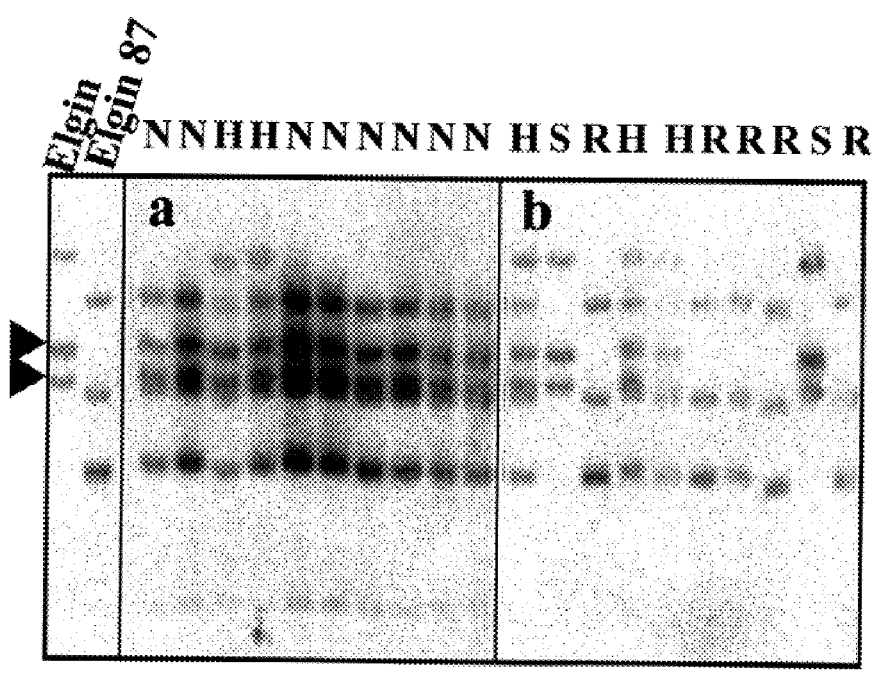
FIG. 3. Illegitimate recombination in the Rps1-k region. The BAC18 end (18R) that overlaps with BAC160 was mapped using ten $F_3$ progenies (a, lane 1–10) and ten F2S (b, lane 1–10) of R910 and R213, respectively. The DNA samples were digested with BclI for this RFLP mapping experiment. R, resistant parent Elgin 87-specific genotype; S, susceptible parent Elgin-specific genotype; H, heterozygotes; N, novel genotype that carries all R-specific and two S-specific (shown by arrows) fragments. R910 contains a breakpoint in between allelomorphs of 18R and TC1.
Figure 4:
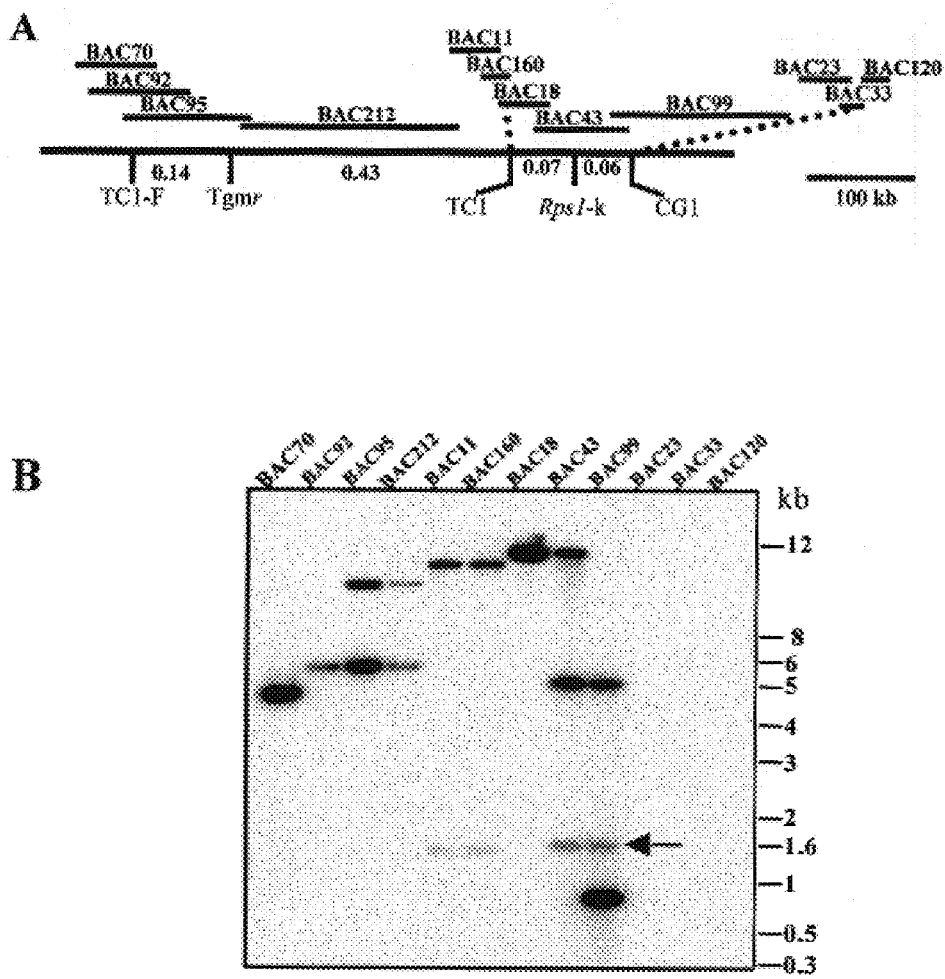
FIG. 4. Identification of a cluster of LRR160-like sequences from the Rps1-k region. A, BAC clones that cover the region spanning from TC1-F to 120(1+2). B, BAC clones shown in A were digested with EcoRI and hybridized to LRR160. LRR160-like sequences were observed from the Rps1-k region to the TC1-F marker. No sequences from BAC23, 33 and 120 hybridized to the probe. The 1.6 kb EcoRI fragment showed by an arrow co-segregates with the Rps1-k locus.
Figure 6:
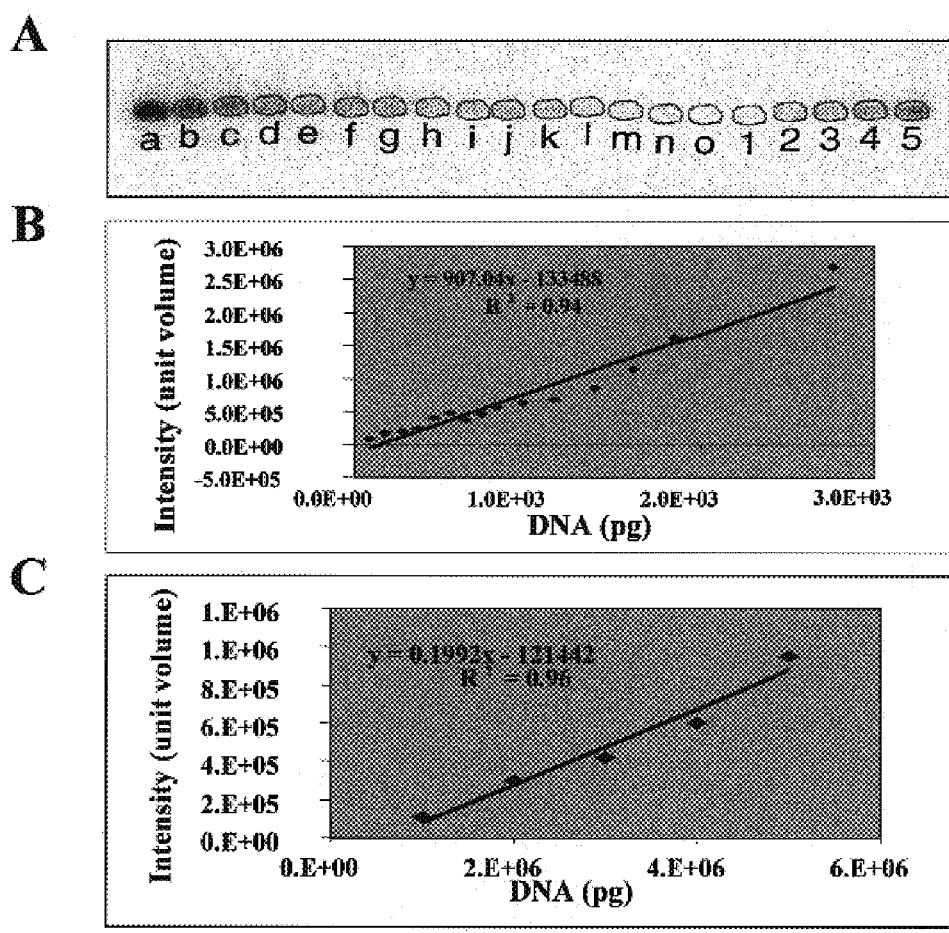
FIG. 6. Copy number of the LRR sequences. (A) Phosphoimage of a Southern blot carrying HindIII digested plasmid pGO2 DNA (a, 5,700 pg; b, 3,800 pg; c, 3,325 pg; d, 2,850 pg; e, 2,375 pg; f, 1,990 pg; g, 1,710 pg; h, 1,520 pg; I, 1,330 pg; j, 1,140 pg; k, 950 pg; l, 760 pg; m, 570 pg; n, 380 pg; o, 190 pg) and soybean genomic DNA (1, 1 μg; 2, 2 μg; 3, 3 μg; 4, 4 μg; and 5, 5 μg) samples hybridized to pGO2-specific LRR sequence. (B) Linear relationship between intensity of hybridization signals (volume) and adjusted concentration of pGO2 DNA content. Values shown in A are adjusted by subtracting the DNA contents for the 9.1 kb pTF101.1 vector. For example, adjusted values for a, b and o are 2770, 1847 and 92 pg, respectively. (C) Linear relationship between intensity of hybridization signals (volume) and concentrations of soybean genomic DNA in picograms.
Figure 7:
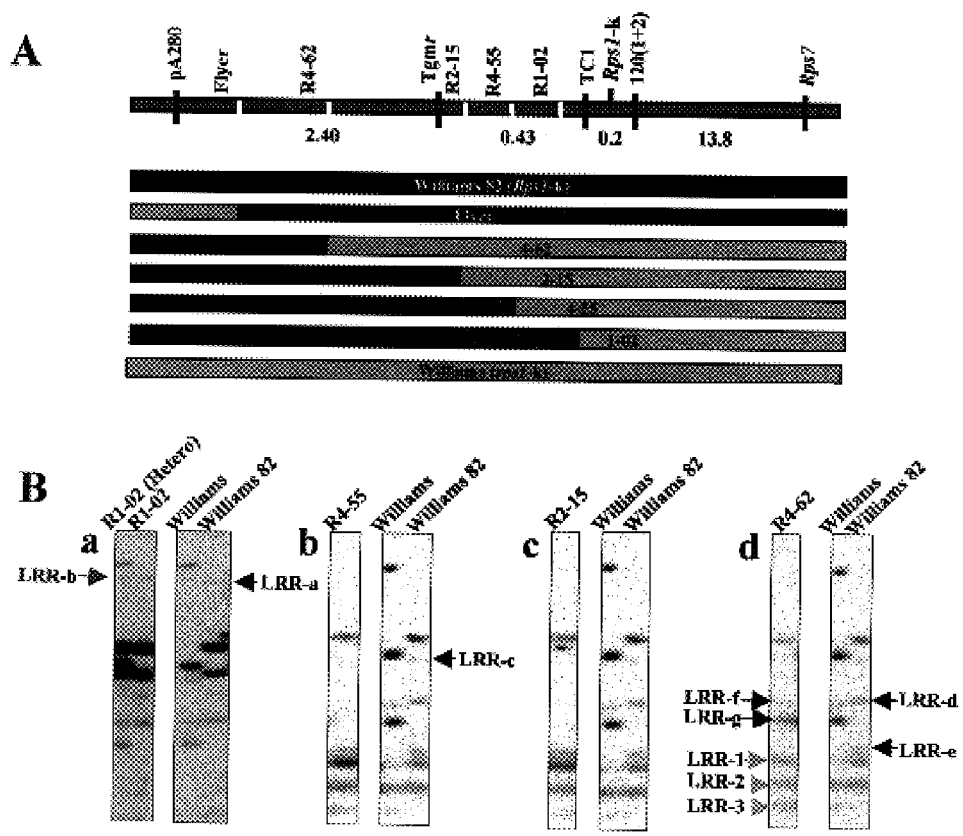
FIG. 7. Mapping of the LRR sequences using near-isogenic lines. (A) Genotype of NILs used in mapping LRR160 are shown against a genetic map of the Rps1-k region. Dark lines represent DNA from the introgressed region carrying Rps1-k. Faint lines represent the DNA from susceptible lines. (B) Southern blot of TaqI digested genomic DNA was hybridized to the pGO2-specific LRR probe and arrows are used to show the LRR sequences mapped to different loci shown in FIG. 7D. Arrows show the Williams 82-specific fragments that disappeared in the recombinant lines due to exchange of DNA strands between parents. For example, the LRR-a fragment is missing from all recombinant lines except R910 or R213 (data not presented). Therefore, this locus was mapped in between recombination break points of R910 and R1-02. In the first panel a heterozygote R1-02 recombinant genotype (R1-02{Hetero}) is included to show that this recombinant received the Williams-specific fragment LRR-b not the LRR-a, which is slightly smaller than LRR-b. LRR-c is missing in all recombinants except in R1-02 (FIG. 7B-a), R910 and R213. Therefore, the LRR-c locus mapped in between the breakpoints of R-02 and R4-55. LRR-d and -e are missing in R4-62, and instead, two Williams-specific fragments LRR-e and -f were observed in this recombinant. Therefore, these fragments were mapped in between breakpoints of R2-15 and R4-62. LRR1, -2, and -3 are mnomorphic and could not be mapped. DraI-digested DNA revealed that the Williams 82-specific pA280 allele (shown by arrow in FIG. 7C-a) is missing in Flyer, therefore, this line carries a breakpoint between Tgmr and pA280. Flyer carries all the LRR sequences observed in Resnik and a fragment-specific to A3127 (shown by arrows in FIG. 7C-b). TaqI-digested DNA (FIGS. 7C-c) supported the results observed for DraI digested DNA that was probed with the LRR probe (FIGS. 7C-b). Flyer carries two A3127 (recurrent parent)-specific TaqI fragments LRR-i and -k in addition to all LRR sequences from the donor parent Williams 82 (FIGS. 7C-c). LRR sequences specific to A3127 observed in Flyer but not in Resnik were mapped to the pA280 locus tentatively. These sequences can, however, be mapped to a locus (loci), south of pA280. Polymorphic fragments LRR-h and -j-specific to Williams 82 were found in Flyer and also in R213 that does not carry any Williams 82 specific DNA beyond CG1 {breakpoint between CG1 and 120(1+2)}. These sequences were also found in other recombinants. Therefore, these were mapped between breakpoints of Flyer and R4-62.
Figure 7:
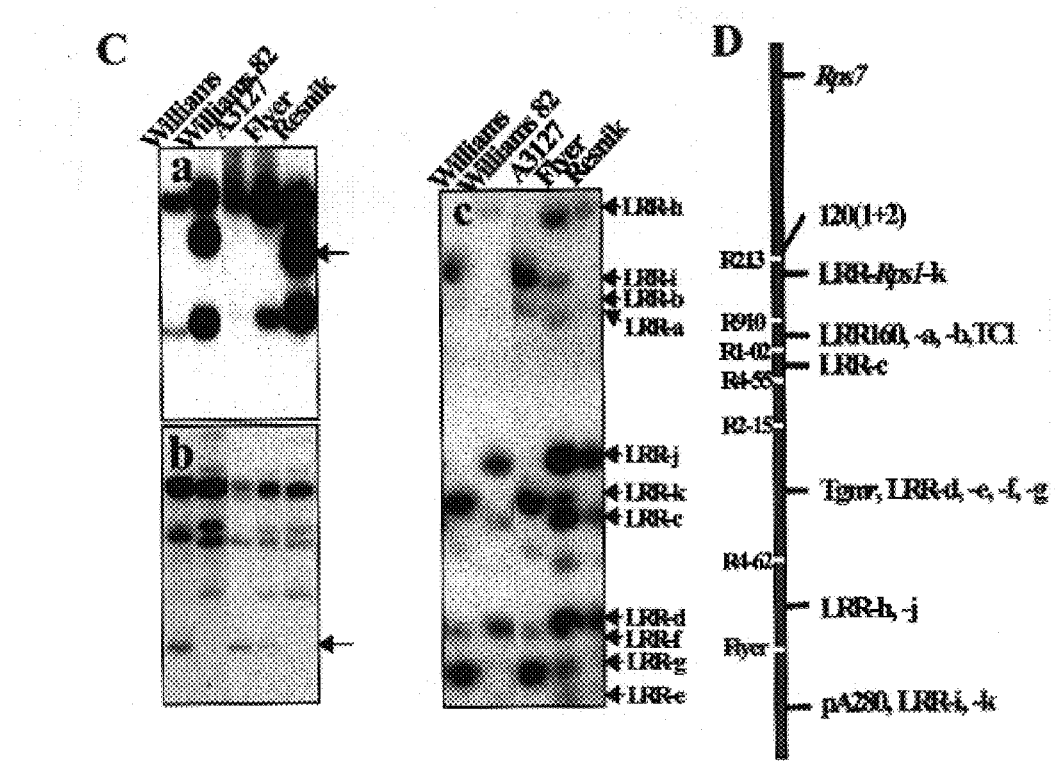
Figure 9:
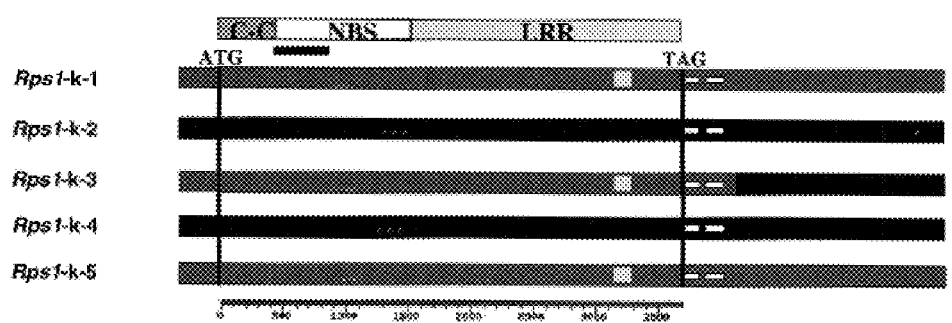
FIG. 9. The Rps1-k gene family comprising two classes of identical genes. In developing this figure, informative polymorphic sites (IPSs) were used to trace the lineages of individual genes. Red and black colors show the lineages of members of the gene family. Rps1-k-1 and -5 are identical genes that were cloned from nonoverlapping BAC18 and BAC99. Rps1-k-3 is distinguished from Rps1-k-1 and -5 by a recombination breakpoint between nts 302 and 478 from the stop codon. Rps1-k-2 and -4 are identical except for a single nt deletion at position 1900 from the stop codon. ■, the conserved nucleotide binding site; *, deletion of an nt; ☐, deletion of 63 nts; ☐, two introns of 142 and 152 nts, respectively.
Figure 11:
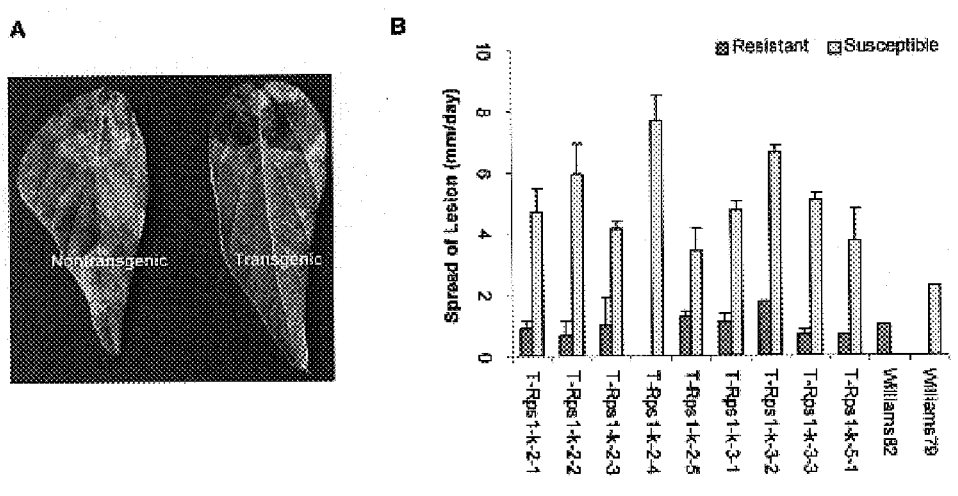
FIG. 11. The complementation analysis of three genes isolated from the Rps1-k locus. (A) A transgenic $R_0$ leaf shows hypersensitive cell death and typical resistance response. (B) Symptom development among $R_1$ progeny populations. Lesion size was recorded two and three days following inoculation and lesion spread was determined in millimeters per day.
Figure 12:
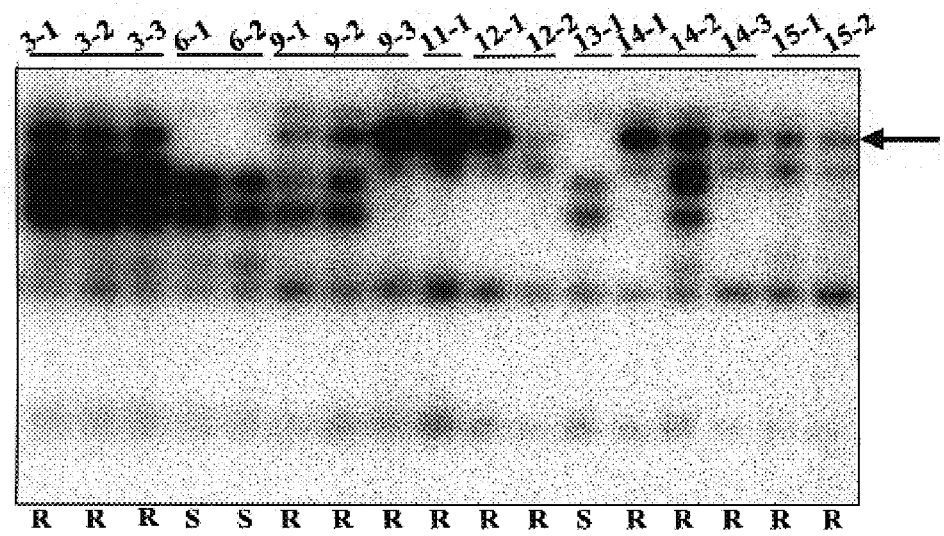
FIG. 12. Co-segregation of an Rps1-k-2 transgene copy with the expression of resistance against P. sojae race 4. Etiolated hypocotyls of individual $R_2$ plants from independent $R_1$ progenies were inoculated with the zoospore suspensions and infected seedlings were evaluated 24 h following inoculation (Ward et al. 1979). Phytophthora resistance was co-segregated with a transgene, which is shown by an arrow.
Figure 13:
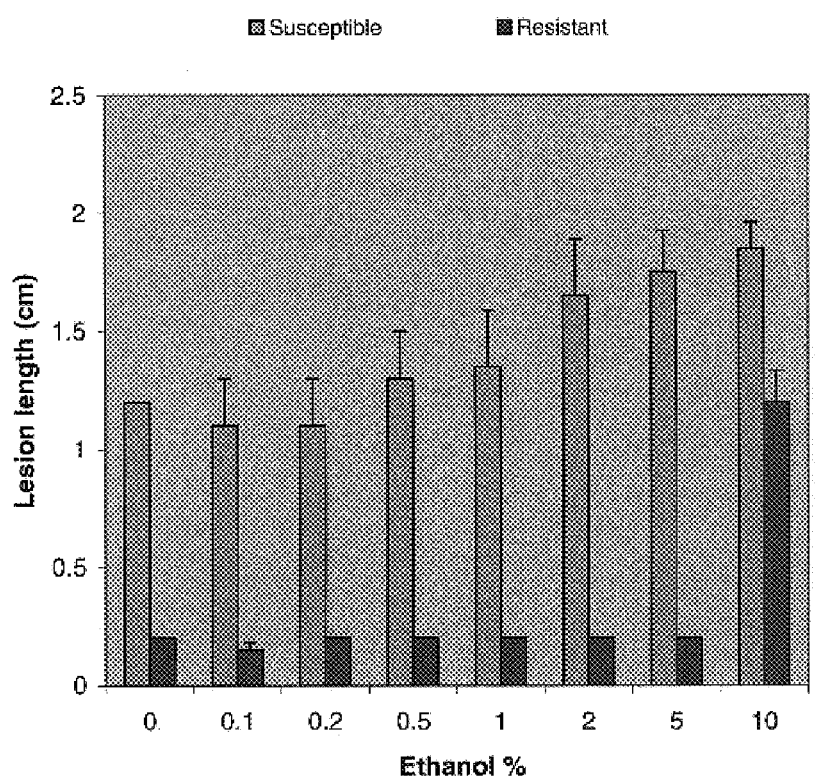
FIG. 13. Lesion development following feeding of soybean seedlings with ethanol. Data were taken 72 h following inoculation. S, Williams inoculated with P. sojae race 1.
Figure 14:
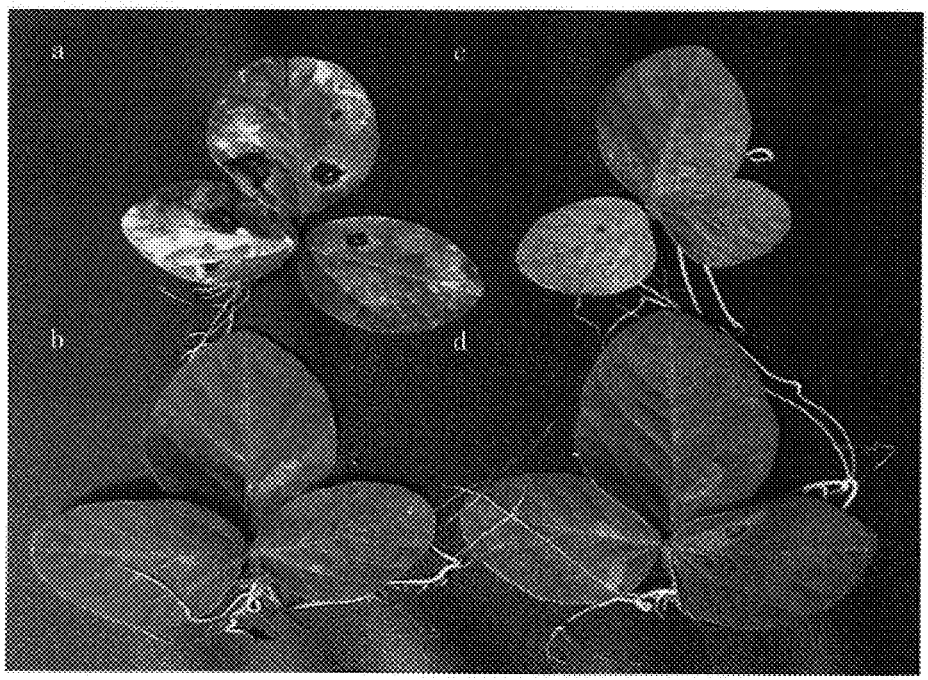
FIG. 14. Immune responses shown by R1 progenies. a. Williams 82 (Rps1-k) trifoliates showing normal resistant response. b and d, trifoliates from two independent $R_1$ plants of an $R_o$ plant ST20-S1-1-1B carrying Rp1-k-3. c, trifoliates from the $R_o$ plant ST22-S1-37C carrying Rp1-k-2. Arrows are used to show poor HR development among transgenic plants.
Figure 19:
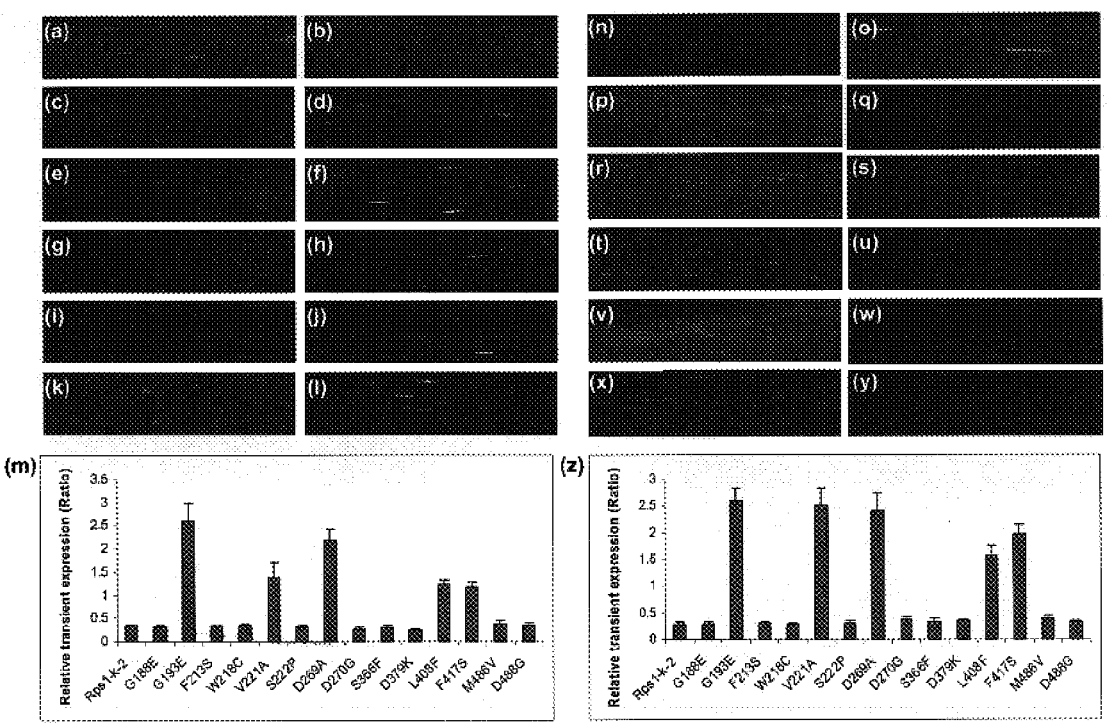

FIG. 19. Identification of amino acids necessary for Rps1-k-2-mediated putative cell death pathway. The reciprocal transient assay system described in FIGS. 3 and 4 was applied in evaluating rps1-k-2 mutants. (a-1), Epi-fluorescence micrographs of 35S:Rps1-k-2 or 35S:rps1-k-2 mutants co-expressed with DsRed2. With each construct combination gold particles coated with empty vector pPadma41 and pGFP were co-bombarded to serve as an internal control. (a–b), Rps1-k-2; (c–d), mutant G193E; (e–f), mutant V221A; (g–h), mutant D269A; (i j), mutant L408F; (k–l), mutant F417S. (m), Relative transient expression levels (as ratios) of DsRed2, when pGDR was co-transformed with 35S:Rps1-k-2 or 14 35S:rps1-k-2 mutants, over GFP expression levels from the internal control comprising the empty vector pPadma41 and pGFP are presented. (n–y), Epi-fluorescence micrographs of 35S:Rps1-k-2 or 35S:rps1-k-2 mutants co-expressed with GFP. With each construct combination gold particles coated with empty vector pPadma41 and pGDR were co-bombarded to serve as an internal control. (n–o), Rps1-k-2; (p–q), mutant G193E; (r–s), mutant V221A; (t–u), mutant D269A; (v–w), mutant L408F; (x–y), mutant F417S. (z), Relative transient expression levels (as ratios) of GFP, when pGFP was co-transformed with 35S:Rps1-k-2 or 14 35S:rps1-k-2 mutants, over DsRed2 expression levels from the internal control comprising the empty vector pPadma41 and pGDR are presented. Two independent experiments, each containing two replications were conducted. In each replication total GFP or DsRed2 positive cells were counted from four transformed hypocotyls. Total number of positive GFP or DsRed2 cells in an individual hypocotyl was considered to calculate ratios. Bar diagrams represent means and standard errors of ratios from a total of 16 transformed hypocotyls.

Figure 5:
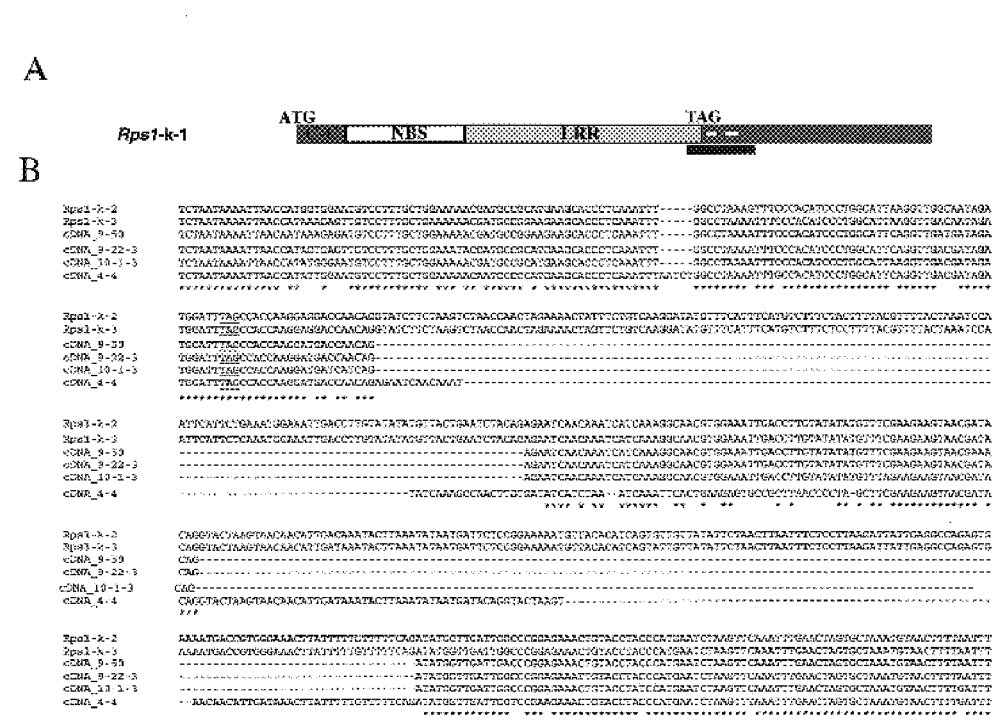
Figure 20A:
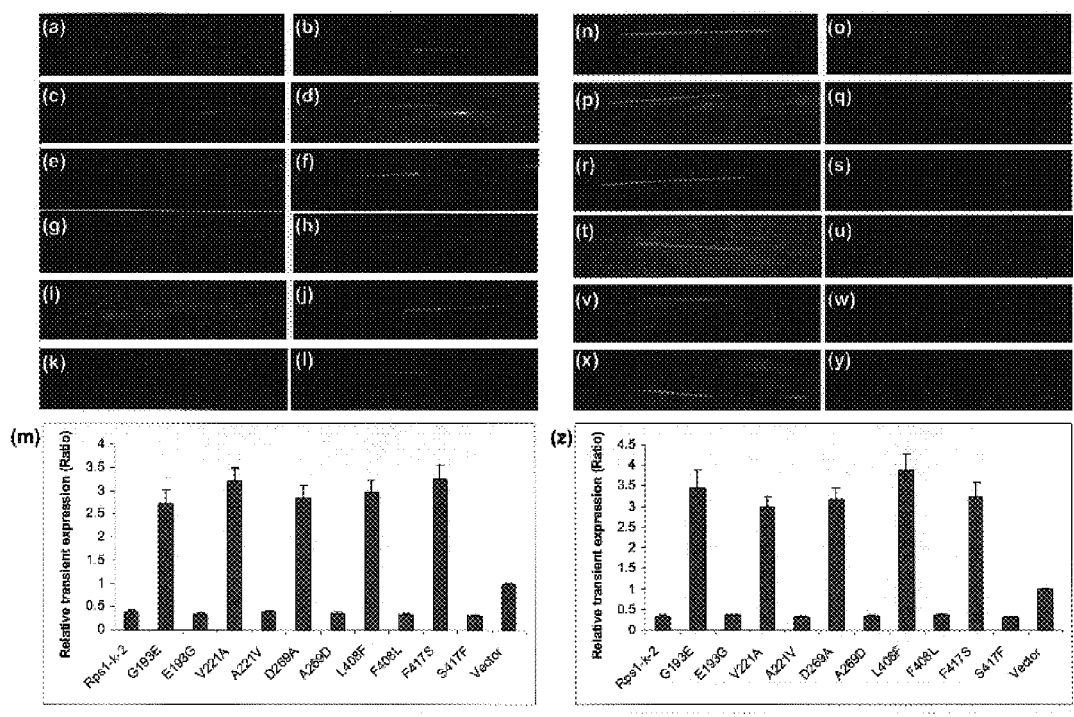

FIG. 20A. Recovery of the Rps1-k-2-mediated putative cell-death phenotype among revertants. The reciprocal transient assay system described in FIGS. 3 and 4 was applied in evaluating revertants of all rps1-k-2 mutants showing loss of putative cell-death function (FIG. 5). (a–l) Epi-fluorescence micrographs of 35S:Rps1-k-2 or revertants co-expressed with GFP and vector pPadma41 co-expressed with DsRed2. (a–b), pPadma45; (c–d), revertant E193G; (e–f), revertant A221V; (g–h), revertant A269D (i j), revertant F408L; (k–l), revertant S417F. (m), Relative transient expression levels (as ratios) of GFP, when pGFP was co-transformed with 35S:Rps1-k-2 or any of the five mutants or their respective revertants, over DsRed2 expression levels from the internal control comprising the empty vector pPadma41 and pGDR are presented. (n–y), Epi-fluorescence micrographs of 35S:Rps1-k-2 or mutants co-expressed with DsRed2 and empty vector pPadma41 with pGFP. (n–o), Rps1-k-2; (p–q), revertant E193G; (r–s), revertant A221V; (t–u), revertant A269D; (v–w), revertant F408L (x–y), revertant S417F. (z), Relative transient expression levels (as ratios) of DsRed2, when pGDR was co-transformed with 35S:Rps1-k-2 or any of the five mutants or their respective revertants, over GFP expression levels from the internal control comprising the empty vector pPadma41 and pGFP are presented. Two independent experiments, each containing two replications were conducted. In each replication total GFP or DsRed2 positive cells were counted from four transformed hypocotyls. Total number of positive cells in an individual hypocotyl was considered for calculating the ratios. Bar diagrams represent means and standard errors of ratios from a total of 16 individual hypocotyls.

Figure 20B:
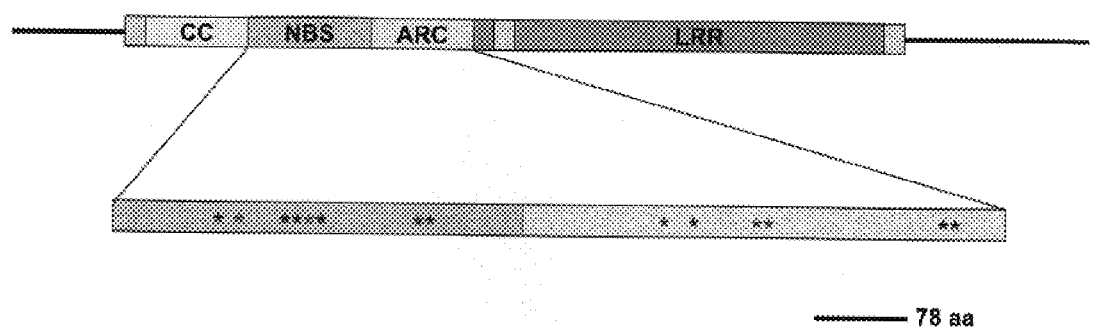

FIG. 20B. Location of five essential amino acids required for the Rps1-k-2-mediated putative cell death pathway. CC, coiled-coil domain; NIB-ARC, a nucleotide binding adaptor shared by APAF-1, certain R proteins and CED-4, and LRR, leucine rich regions. The gray boxes are regions between the conserved domains. Black stars represent the locations of substituted amino acids that did not alter the Rps1-k-2-mediated putative cell death function. Red stars indicate the locations of five amino acids that are essential for the expression of the Rps1-k-2-mediated putative cell death function.

Figure 21:
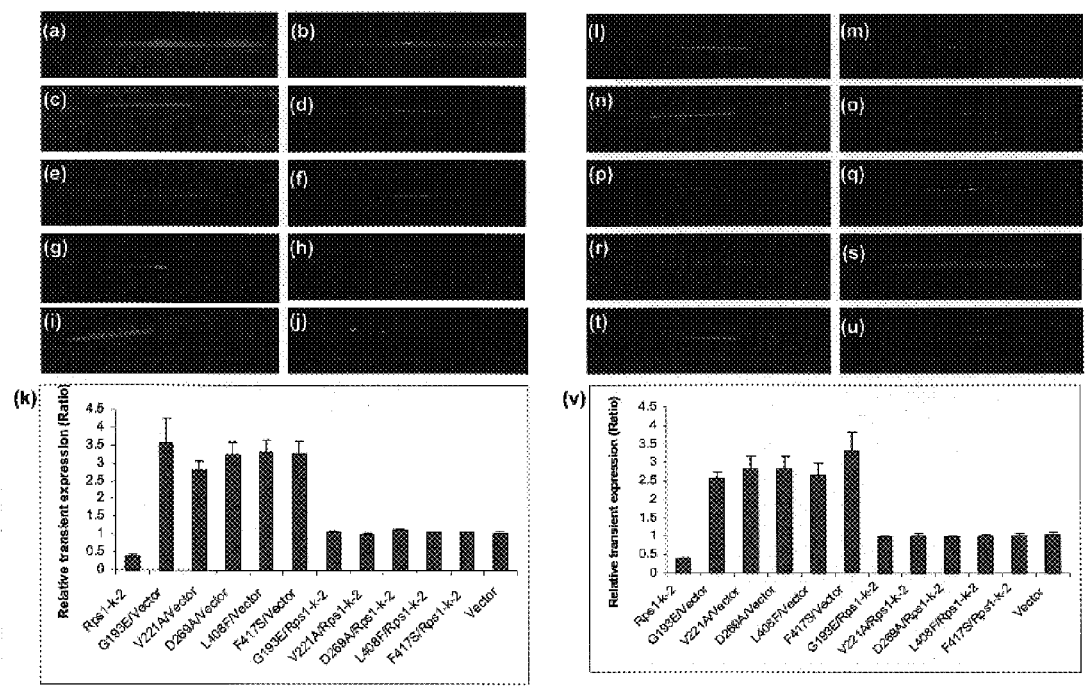

FIG. 21. Rps1-k-2 mediated putative cell death pathway is suppressed by co-expression of rps1-k-2 mutants. 35S:Rps1-k-2 was coated onto gold particles with individual mutants and a reporter gene. Corresponding mutants and the other reporter gene were cobombarded to serve as an internal control. (a–j)) Epi-fluorescence micrographs of 35S:Rps1-k-2 and any of the five mutants co-expressed with GFP. With each combination of 35S:Rps1-k-2 and mutants pPadma41 and pGDR were co-bombarded to serve as an internal control. (a–b), mutant G193E; (c–d), mutant V221A (e–f); D269A (g–h), mutant L408F; (i j), mutant F417S. (k), Relative transient expression levels (as ratios) of GFP, when pGFP was co-transformed with 35S:Rps1-k-2 or any of the five mutants, over DsRed2 expression levels from the internal control comprised of the respective mutant and pGDR are presented. (1-u) Epi-fluorescence micrographs of 35S:Rps1-k-2 and any one of the five mutants co-expressed with DsRed2. With each combination of 35S:Rps1-k-2 and mutants pPadma41 and pGFP were co-bombarded to serve as an internal control. (l–m), mutant G193E; (n–o), mutant V221A; (P–q), mutant D269A; (r–s), mutant L408F; (t–u), mutant F417S. (v), Relative transient expression levels (as ratios) of DsRed2, when pGDR was co-transformed with 35S:Rps1-k-2 or any of the five mutants, over GFP expression levels from the internal control comprised of the respective mutant and pGFP are presented. Two independent experiments, each containing two replications were conducted. In each replication total GFP or DsRed2 positive cells were counted from four transformed hypocotyls. Total number of GFP or DsRed2 positive cells from individual hypocotyls were used to determine the ratios. Bar diagrams in (k) and (v) represent means and standard errors from a total of 16 hypocotyls.

SEQUENCE LISTING (182 sequences)

SEQ ID NO: 1 - DNA, 3690 bp, Glycine max
  CDS (1)..(3690)
atggctgcagcactggtcggtggtgcctttctctctgctttccttgatgtgcttttcgacaggctggcttcacctgactttgttgacttgatccttggaaagaagcttagcaagaagttgcttcgaaagttggagaccactctcagagtggttggagctgtgcttgatgatgccgagaagaaacagatcacaaacaccaatgtcaaacactggctcaatgctctcaaagatgctgtctatgaagccgatgacttactcgaccatgttttcaccaaagctgccacccaaaacaaggtaagaaacttgttttctcgcttttccgatcggaagatcgttagtaagttggaggacatagttgtcaccctagagtctcatttaaaactcaaggagagtcttgatttgaaagagagtgcagtggagaacttgtcatggaaagctccatcaacatctctggaagatggatctcatatatatggtagggagaaagatagggaggccataatcaagttgttgtcggaggataacagtgacggtagtgaagtgtctgtggttcctattgtgggcatgggtggggttggaaaaactactttggcccaattggtgtacaatgatgagaatttgaaagagaaatttgattttgattttaaggcatgggtttgtgtttctcaagaatttgatgttctgaaggtcacaaaaactataatacaggcggttactggaaatccttgtaaattgaatgatctgaatctacttcatcttgaattgatggacaagctgaaagataaaaaattcctaattgttttggatgatgtttggacagaggattatgttgattggagtcttcttaagaaaccatttcaatgtgggattattaggagaagtaaaattcttctaacaacccgcagtgaaaagacagcctccgtagtccaaacggttcaaacctatcatctaaaccaattgtcgaatgaagattgttggtcagtgtttgcgaaccatgcgtgtctttccttggaatcgaacgagaacacaacactagaaaaaattggaaaggagattgttaaaaagtgcgatggactgcctttagcagcacagtcccttggaggcatgttgagaagaaagcatgacattggggattggtataatattctgaatagtgacatttgggaactttctgaaagtgagtgtaaagttattccagcactgagacttagttatcattatctccctccacatttaaaacggtgctttgtttattgttcgttgtatccccaagattacgaatttgataaaaatgaattaatcttgttgtggatggctgaagatcttttgaagaaaccaaggaaaggtaggactttagaagaggttggtcatgagtattttgatgatttggtttcgagatcatttttccaacgttcaagtacaaatagaagtagttggccttatggtgaatgttttgtgatgcatgacctcatgcatgatctagccaaatcactcggtggagatttttattttagatcagaagaacttgggaaagaaacaaagatcaatactaagactcgtcatttgtcatttaccaaattcaattcttcagtcttggacaactttgatgttgttggtagagcaaaatttctgagaactttcttgtccattatcaattttgaagctgctccattcaacaacgaggaggcacaatgtatcattgtgtcgaagcttatgtacttgagagttttatcattttgtgacttccaaagtttggattctttgcctgattcaataggtaaattgatccatctgcgctatttagatctttctcattcaagtgtagaaacactgccaaagtcattgtgtaatttatacaatctgcaaactttgaagttgtgtagttgcagaaagctgactaagttgcctagtgacatgtgcaatcttgttaacttgcgtcatcttgagatacgtgaaactcctatagaagagatgccgagaggaatgagtaaattaaatcatctacaacatctggatttctttgttgtgggcaagcacaaagagaatgggatcaaagaattgggaggactttcaaatcttcgtggtcgacttaaaattaggaacttggagaatgtttcccaaagtgatgaagcgtcggaggcaaggatgatggataaaaaacacattaatagtttatggttggaatggtctagatgtaataacaacagtaccaacttccaactagaaatagatgtgctttgcaagttacagcctcactttaacattgaatcgttgagaataaaaggctataaaggaaccagatttccagattggatgggaaattcttcctactgcaatatgatgagtctaaaattgcgtgattgtgacaactgtagtatgcttccttcacttggacaactaccttctctcaaggtccttaagattgcacgattgaataggctgaagactattgatgcaggtttttacaagaacgaagattgtcgttctgggacgccctttccctcccttgaatctctggccattcatcaaatgccttgttgggaggtgtggagttccttcgattcagaagcttttcctgtgcttgaaattcttgaaatacgtgactgccccaaactagagggaagtttgccgaatcaccttcctgctctgaaaacacttacaattagaaattgtgagctgcttggctcttctctcccaacggctcccgccattcaaagtttggagatacgtaaaagcaataaagtagcactgcatgcgtttcctctcttggtagaaactataaaagtagaaggaagcccaatggtggagtccatgatggaggccatcacaaacatccaaccaacttgtctccggtctttaacattaagggattgctcgtcagccgtgtcatttccgggtggtcgtttacctgaatcactgaagagtctgtatatctcggatcttaaaaaactggaattcccgacgcaacacaaacatgagttactggaaacactgtcaatagaaagcagttgtgattcactcacatctcttccattggttacctttccaaatctcagagatcttgaaatcagaaactgtgaaaatatggaatctcttttggtatcattctggagagaaggattgcctgcgcccaacttgattactttccaagtgtggggctctgacaagttgaagtcgttgcctgatgagatgagtactcttctcccaaagttagaacgtctcctcatatccaactgcccagaaattgagtcgtttccaaaacggggtatgccacctaacctgagaatagtttggattttcaattgtgagaaactactgagcagcctagcatggccatccatgggcatgcttactcatctctatgttgggggtcgatgtgatggcatcaagtccttccctaaggagggtttgctgcctccctcccttacgtatctgtatctaagtggattctcaaatctggagatgttggactgcacggggcttctccatctcacatccctgcaacaattaaccatagacggatgtcctttgctggaaaatatggtgggagaaaggcttcctgactctctaataaaattaaccataaagagttgtcctttgctgaaaaaacgatgccggaagaagcaccctcaaatttggcctaaaatttcccacatccctggcattaaggttgacaatagatggatttag

SEQ ID NO: 2 - protein, 1229 aa, Glycine max
MAAALVGGAFLSAFLDVLFDRLASPDFVDLILGKKLSKKLLRKLETTLRVVGAVLDDAEKKQITNTNVKHWLNALKDAVYEADDLLDHVFTKAATQNKVRNLFSRFSDRKIVSKLEDIVVTLESHLKLKESLDLKESAVENLSWKAPSTSLEDGSHIYGREKDREAIIKLLSEDNSDGSEVSVVPIVGMGGVGKTTLAQLVYNDENLKEKFDFDFKAWVCVSQEFDVLKVTKTIIQAVTGNPCKLNDLNLLHLELMDKLKDKKFLIVLDDVWTEDYVDWSLLKKPFQCGIIRRSKILLTTRSEKTASVVQTVQTYHLNQLSNEDCWSVFANHACLSLESNENTTLEKIGKEIVKKCDGLPLAAQSLGGMLRRKHDIGDWYNILNSDIWELSESECKVIPALRLSYHYLPPHLKRCFVYCSLYPQDYEFDKNELILLWMAEDLLKKPRKGRTLEEVGHEYFDDLVSRSFFQRSSTNRSSWPYGECFVMHDLMHDLAKSLGGDFYFRSEELGKETKINTKTRHLSFTKFNSSVLDNFDVVGRAKFLRTFLSIINFEAAPFNNEEAQCIIVSKLMYLRVLSFCDFQSLDSLPDSIGKLIHLRYLDLSHSSVETLPKSLCNLYNLQTLKLCSCRKLTKLPSDMCNLVNLRHLEIRETPIEEMPRGMSKLNHLQHLDFFVVGKHKENGIKELGGLSNLRGRLKIRNLENVSQSDEASEARMMDKKHINSLWLEWSRCNNNSTNFQLEIDVLCKLQPHFNIESLRIKGYKGTRFPDWMGNSSYCNMMSLKLRDCDNCSMLPSLGQLPSLKVLKIARLNRLKTIDAGFYKNEDCRSGTPFPSLESLAIHQMPCWEVWSSFDSEAFPVLEILEIRDCPKLEGSLPNHLPALKTLTIRNCELLGSSLPTAPAIQSLEIRKSNKVALHAFPLLVETIKVEGSPMVESMMEAITNIQPTCLRSLTLRDCSSAVSFPGGRLPESLKSLYISDLKKLEFPTQHKHELLETLSIESSCDSLTSLPLVTFPNLRDLEIRNCENMESLLVSFWREGLPAPNLITFQVWGSDKLKSLPDEMSTLLPKLERLLISNCPEIESFPKRGMPPNLRIVWIFNCEKLLSSLAWPSMGMLTHLYVGGRCDGIKSFPKEGLLPPSLTYLYLSGFSNLEMLDCTGLLHLTSLQQLTIDGCPLLENMVGERLPDSLIKLTIKSCPLLKKRCRKKHPQIWPKISHIPGIKVDNRWI

SEQ ID NO: 3 - DNA, 3690 bp, Glycine max; identical to SEQ ID NO: 1
  CDS (1)..(3690)

SEQ ID NO: 4 - protein, 1229 aa, Glycine max; identical to SEQ ID NO: 2

SEQ ID NO: 5 - DNA, 3690 bp, Glycine max; identical to SEQ ID NO: 1
  CDS (1)..(3690)

SEQ ID NO: 6 - protein, 1229 aa, Glycine max; identical to SEQ ID NO: 2

SEQ ID NO: 7 - DNA, 3690 bp, Glycine max; identical to SEQ ID NO: 1
  CDS (1)..(3690)

SEQ ID NO: 8 - protein, 1229 aa, Glycine max; identical to SEQ ID NO: 2

SEQ ID NO: 9 - DNA, 3753 bp, Glycine max
  CDS (1)..(3753)
atggctgcagcactggtcggtggtgcctttctctctgctttccttgatgtgcttttcgacaggctggcttcacctgactttgttgacttgatccttggaaagaagcttagcaagaagttgcttcgaaagttggagaccactctcagagtggttggagctgtgcttgatgatgccgagaagaaacagatcacaaacaccaatgtcaaacactggctcaatgctctcaaagatgctgtctatgaagccgatgacttactcgaccatgttttcaccaaagctgccacccaaaacaaggtaagaaacttgttttctcgcttttccgatcggaagatcgttagtaagttggaggacatagttgtcaccctagagtctcatttaaaactcaaggagagtcttgatttgaaagagagtgcagtggagaacttgtcatggaaagctccatcaacatctctggaagatggatctcatatatatggtagggagaaagatagggaggccataatcaagttgttgtcggaggataacagtgacggtagtgaagtgtctgtggttcctattgtgggcatgggtggggttggaaaaactactttggcccaattggtgtacaatgatgagaatttgaaagagaaatttgattttgattttaaggcatgggtttgtgtttctcaagaatttgatgttctgaaggtcacaaaaactataatacaggcggttactggaaatccttgtaaattgaatgatctgaatctacttcatcttgaattgatggacaagctgaaagataaaaaattcctaattgttttggatgatgtttggacagaggattatgttgattggagtcttcttaagaaaccatttcaatgtgggattattaggagaagtaaaattcttctaacaacccgcagtgaaaagacagcctccgtagtccaaacggttcaaacctatcatctaaaccaattgtcgaatgaagattgttggtcagtgtttgcgaaccatgcgtgtctttccttggaatcgaacgagaacacaacactagaaaaaattggaaaggagattgttaaaaagtgcgatggactgcctttagcagcacagtcccttggaggcatgttgagaagaaagcatgacattggggattggtataatattctgaatagtgacatttgggaactttctgaaagtgagtgtaaagttattccagcactgagacttagttatcattatctccctccacatttaaaacggtgctttgtttattgttcgttgtatccccaagattacgaatttgataaaaatgaattaatcttgttgtggatggctgaagatcttttgaagaaaccaaggaaaggtaggactttagaagaggttggtcatgagtattttgatgatttggtttcgagatcatttttccaacgttcaagtacaaatagaagtagttggccttatggtgaatgttttgtgatgcatgacctcatgcatgatctagccaaatcactcggtggagatttttattttagatcagaagaacttgggaaagaaacaaagatcaatactaagactcgtcatttgtcatttaccaaattcaattcttcagtcttggacaactttgatgttgttggtagagcaaaatttctgagaactttcttgtccattatcaattttgaagctgctccattcaacaacgaggaggcacaatgtatcattgtgtcgaagcttatgtacttgagagttttatcattttgtgacttccaaagtttggattctttgcctgattcaataggtaaattgatccatctgcgctatttagatctttctcattcaagtgtagaaacactgccaaagtcattgtgtaatttatacaatctgcaaactttgaagttgtgtagttgcagaaagctgactaagttgcccagtgacatgcgcaatcttgttaacttgcgtcatcttggtattgcttatactcctataaaagagatgccgagaggaatgggtaaattaaatcatttacaacatctggatttctttgttgtgggcaagcacgaagagaatggaatcaaagaattgggaggactttcaaatcttcgtggtcagcttgaaattaggaagttggagaatgtttcccaaagtgatgaagcgttggaggcaaggatgatggataaaaaacacattaatagtttacagttggaatggtctggatgtaacaacaacagtaccaacttccaacttgaaatagatgtgctttgcaagttacagcctcactttaacattgaatcgttggaaataaaaggttatgaaggaaccagatttccagattggatgggaaattcttcctactgcaatatgattagtctaaaattgcgtgattgtgacaactgtagtatgcttccttcacttggacaactaccttctctcaaggtccttaagattgcacgattgaataggctgaagactattgatgcaggtttttacaagaacgaagattgtcgttctgggacgccctttccctcccttgaatctctggccattcatcaaatgccttgttgggaggtgtggagttccttcgattcagaagcttttcctgtgcttgaaattcttgaaatacgtgactgccccaaactagagggaagtttgccgaatcaccttcctgctctgaaaacacttacaattagaaattgtgagctgcttggctcttctctcccaacggctcccgccattcaaagtttggagatacgtaaaagcaataaagtagcactgcatgcgtttcctctcttggtagaaactataaaagtagaaggaagcccaatggtggagtccatgatggaggccatcacaaacatccaaccaacttgtctccggtctttaacattaagggattgctcgtcagccgtgtcatttccgggtggtcgtttacctgaatcactgaagagtctgtatatcaaggatcttaaaaaactggaattcccgacgcaacacaaacatgagttactggaaacactgtcaatagaaagcagttgtgattcactcacatctcttccattggttacctttccaaatctcagatatctcagcatcgaaaagtgtgaaaatatggaatatcttttggtttcaggggcagagtcatttaagagtctgtgttatttgttaatttacaaatgccccaactttgtatcattctggagagaaggattgcctgcgcccaacttgattactttccaagtgtggggctctgacaagttgaagtcgttgcctgatgagatgagtactcttctcccaaagttagaacgtctcctcatatccaactgcccagaaattgagtcgtttccaaaacggggtatgccacctaacctgagaatagtttggattttcaattgtgagaaactactgagcagcctagcatggccatccatgggcatgcttactcatctctatgttgggggtcgatgtgatggcatcaagtccttccctaaggagggtttgctgcctccctcccttacgtatctgtatctaagtggattctcaaatctggagatgttggactgcacggggcttctccatctcacatccctgcaacaattaaccatagacggatgtcctttgctggaaaatatggtgggagaaaggcttcctgactctctaataaaattaaccataaagagttgtcctttgctgaaaaaacgatgccggaagaagcaccctcaaatttggcctaaaatttcccacatccctggcattaaggttgacaatagatggatttag

SEQ ID NO: 10 - protein, 1250 aa, Glycine max
MAAALVGGAFLSAFLDVLFDRLASPDFVDLILGKKLSKKLLRKLETTLRVVGAVLDDAEKKQITNTNVKHWLNALKDAVYEADDLLDHVFTKAATQNKVRNLFSRFSDRKIVSKLEDIVVTLESHLKLKESLDLKESAVENLSWKAPSTSLEDGSHIYGREKDREAIIKLLSEDNSDGSEVSVVPIVGMGGVGKTTLAQLVYNDENLKEKFDFDFKAWVCVSQEFDVLKVTKTIIQAVTGNPCKLNDLNLLHLELMDKLKDKKFLIVLDDVWTEDYVDWSLLKKPFQCGIIRRSKILLTTRSEKTASVVQTVQTYHLNQLSNEDCWSVFANHACLSLESNENTTLEKIGKEIVKKCDGLPLAAQSLGGMLRRKHDIGDWYNILNSDIWELSESECKVIPALRLSYHYLPPHLKRCFVYCSLYPQDYEFDKNELILLWMAEDLLKKPRKGRTLEEVGHEYFDDLVSRSFFQRSSTNRSSWPYGECFVMHDLMHDLAKSLGGDFYFRSEELGKETKINTKTRHLSFTKFNSSVLDNFDVVGRAKFLRTFLSIINFEAAPFNNEEAQCIIVSKLMYLRVLSFCDFQSLDSLPDSIGKLIHLRYLDLSHSSVETLPKSLCNLYNLQTLKLCSCRKLTKLPSDMRNLVNLRHLGIAYTPIKEMPRGMGKLNHLQHLDFFVVGKHEENGIKELGGLSNLRGQLEIRKLENVSQSDEALEARMMDKKHINSLQLEWSGCNNNSTNFQLEIDVLCKLQPHFNIESLEIKGYEGTRFPDWMGNSSYCNMISLKLRDCDNCSMLPSLGQLPSLKVLKIARLNRLKTIDAGFYKNEDCRSGTPFPSLESLAIHQMPCWEVWSSFDSEAFPVLEILEIRDCPKLEGSLPNHLPALKTLTIRNCELLGSSLPTAPAIQSLEIRKSNKVALHAFPLLVETIKVEGSPMVESMMEAITNIQPTCLRSLTLRDCSSAVSFPGGRLPESLKSLYIKDLKKLEFPTQHKHELLETLSIESSCDSLTSLPLVTFPNLRYLSIEKCENMEYLLVSGAESFKSLCYLLIYKCPNFVSFWREGLPAPNLITFQVWGSDKLKSLPDEMSTLLPKLERLLISNCPEIESFPKRGMPPNLRIVWIFNCEKLLSSLAWPSMGMLTHLYVGGRCDGIKSFPKEGLLPPSLTYLYLSGFSNLEMLDCTGLLHLTSLQQLTIDGCPLLENMVGERLPDSLIKLTIKSCPLLKKRCRKKHPQIWPKISHIPGIKVDNRWI

SEQ ID NO: 11 - DNA, 3750 bp, Glycine max
  CDS (1)..(3750)
atggcagcagcactggtcggtggtgccttcctctctgcttttcttgatgtggttttcgacaggctggcttcacctgagtttgttgacttgatccgtggaaagaagcttagcaagaagttgcttcaaaagttggagaccactctcagagtggttggagctgtgcttgatgatgccgagaagaaacagatcacaaacaccaatgtcaaacactggctcaatgatctcaaacatgctgtctatgaagccgatgacttactcgaccatgttttcaccaaagctgccacccaaaacaaggtaagagacttgttttctcgcttttccgataggaagatcgttagtaagttggaggacatagttgtcacacttgagtctcatttaaaactcaaggagagtcttgatttgaaagagagtgcagtggagaacttgtcatggaaagctccatcaacatctctggaagatggatctcatatatatggtagggagaaagataaggaggccataatcaagttgttgtcggaggataacagtgacggtagagaagtgtctgtggttcctattgtgggcatgggtggggttggaaaaactactttggcccaattggtgtacaacgatgagaatttgaaacagatatttgattttgattttaaggcatgggtttgtgtttctcaagaatttgatgttctcaaggtcacaaaaactataatagaggcggtgactggaaaggcttgtaaattgaatgatctgaatctacttcatcttgaattgatggacaagctgaaagataaaaaattcttaattgttttggatgatgtttggacagaggattatgttgattggcgtcttcttaagaaaccatttaaccgtgggattattaggagaagtaaaattcttctaacaacccgcagtgaaaaaacagcatctgtagtccaaactgttcacacctatcatctaaaccaattgtcgaatgaagattgttggtcagtgtttgcgaaccatgcatgtctttccacggaatctaacgagaacacagcaacactagaaaaaattggaaaggagattgttaaaaagtgcaacggactgcctttagcagcagagtcgcttggaggcatgttgagaagaaagcatgacattggtgattggaataatattctcaatagtgacatttgggaactttctgaaagtgagtgtaaagttattccagcactgagacttagttatcattatctccctccacatttaaaacgatgctttgtttattgttcgttgtatccacaagattacgaatttgaaaaaaatgaattaatcttgttgtggatggctgaagatcttttgaagaaaccaaggaaaggtaggactttagaagaggttggtcatgagtattttgatgatttggtttcgagatcgtttttccaacgttcaagaacaagtagttggcctcatcgcaaatgttttgtgatgcatgacctcatgcatgatctagccacatcactcggtggagatttttattttagatcagaagaacttgggaaagaaacaaagatcaataccaagactcgtcatttgtcatttgccaaattcaattcttcagtcttggacaactttgatgttattggtagagcaaaatttctgagaaccttcttgtccattatcaattttgaagctgctccattcaacaatgaggaggcacaatgtatcataatgtcgaagcttatgtacttgagagttttatcattttgtgacttccaaagtctggattctttgcctgattcaataggtaaattgatccatctgcgctatttagatctctctttttcaagaatagaaacactgccaaagtcattgtgtaatttgtacaatctgcaaactttgaagttgtgtagttgcagaaagctgactaagttgcccagtgacatgcgcaatcttgttaacttgcgtcatcttggtattgcttatactcctataaaagagatgccgagaggaatgggtaaattaaatcatttacaacatctggatttctttgttgtgggcaagcacgaagagaatggaatcaaagaattgggaggactttcaaatcttcgtggtcagcttgaaattaggaagttggagaatgtttcccaaagtgatgaagcgttggaggcaaggatgatggataaaaaacacattaatagtttacagttggaatggtctggatgtaacaacaacagtaccaacttccaacttgaaatagatgtgctttgcaagttacagcctcactttaacattgaatcgttggaaataaaaggttatgaaggaaccagatttccagattggatgggaaattcttcctactgcaatatgattagtctaaaattgcgtgattgtcacaactgtagtatgcttccttcacttggacaactaccttctctcaaggaccttggaattgcacgattgaataggctgaagactattgatgcaggtttctacaagaatgaagaatgtcgttctgggacgtcctttccctcccttgaatctctgtccattgatgacatgccttgttgggaggtgtggagttccttcgattcagaagcttttcctgtgcttaacagtcttgaaatacgtgactgccccaaactagagggaagtttgccgaatcaccttcctgctctgacaaaacttgtgattagaaattgcgagctgcttgtctcttctctcccaacggctcccgccattcaaagtttggagatatgtaaaagcaataaagtagcactgcatgcgtttcctctcttggtagaaactatagaagtagaaggaagcccaatggtggagtccgtgatcgaggccatcactaacatccaaccaacttgtctccggtctttaacattaagggattgttcgtcagccgtgtcatttccgggtggtcgtttacctgaatcactgaagagtctgagtatcaaggatcttaaaaaactggaattcccgacgcaacacaaacatgagttactggaaacactgtcaatagaaagcagttgtgattcactcacatctcttccattggttacctttccaaatctcagatatctcagcatcgaaaagtgtgaaaatatggaatatcttttggtttcaggggcagagtcatttaagagtctgtgttatttgttaatttacaaatgccccaactttgtatcattctggagagaaggattgcctgcgcccaacttgattactttcagtgtttggggctctgacaagttgaagtcgttgcctgatgagatgagtactcttctcccaaagttagaagatctcaccatatccaactgcccagaaattgagtcctttccaaaacggggtatgccacctaacctgagaagagttgagattgtcaattgtgagaaactactgagcggcctagcatggccatccatgggcatgcttactcatctcaatgttgggggtccatgtgatggcatcaagtccttccctaaagagggtttgctgcctccctcccttacgtctctgtctctatatgacttgtcaaatctggagatgttggactgcacggggcttctccatctcacatccctgcaacaattacaaatttttggatgtccaaagctggagaatatggctggagaaagtcttcctttctctctaataaaattaaccatggtggaatgtcctttgctggaaaaacgatgccgcatgaagcaccctcaaatttggcctaaagtttcccacatccctggcattaaggttggcaatagatggatttag

SEQ ID NO: 12 - protein, 1249 aa, Glycine max
MAAALVGGAFLSAFLDVVFDRLASPEFVDLIRGKKLSKKLLQKLETTLRVVGAVLDDAEKKQITNTNVKHWLNDLKHAVYEADDLLDHVFTKAATQNKVRDLFSRFSDRKIVSKLEDIVVTLESHLKLKESLDLKESAVENLSWKAPSTSLEDGSHIYGREKDKEAIIKLLSEDNSDGREVSVVPIVGMGGVGKTTLAQLVYNDENLKQIFDFDFKAWVCVSQEFDVLKVTKTIIEAVTGKACKLNDLNLLHLELMDKLKDKKFLIVLDDVWTEDYVDWRLLKKPFNRGIIRRSKILLTTRSEKTASVVQTVHTYHLNQLSNEDCWSVFANHACLSTESNENTATLEKIGKEIVKKCNGLPLAAESLGGMLRRKHDIGDWNNILNSDIWELSESECKVIPALRLSYHYLPPHLKRCFVYCSLYPQDYEFEKNELILLWMAEDLLKKPRKGRTLEEVGHEYFDDLVSRSFFQRSRTSSWPHRKCFVMHDLMHDLATSLGGDFYFRSEELGKETKINTKTRHLSFAKFNSSVLDNFDVIGRAKFLRTFLSIINFEAAPFNNEEAQCIIMSKLMYLRVLSFCDFQSLDSLPDSIGKLIHLRYLDLSFSRIETLPKSLCNLYNLQTLKLCSCRKLTKLPSDMRNLVNLRHLGIAYTPIKEMPRGMGKLNHLQHLDFFVVGKHEENGIKELGGLSNLRGQLEIRKLENVSQSDEALEARMMDKKHINSLQLEWSGCNNNSTNFQLEIDVLCKLQPHFNIESLEIKGYEGTRFPDWMGNSSYCNMISLKLRDCHNCSMLPSLGQLPSLKDLGIARLNRLKTIDAGFYKNEECRSGTSFPSLESLSIDDMPCWEVWSSFDSEAFPVLNSLEIRDCPKLEGSLPNHLPALTKLVIRNCELLVSSLPTAPAIQSLEICKSNKVALHAFPLLVETIEVEGSPMVESVIEAITNIQPTCLRSLTLRDCSSAVSFPGGRLPESLKSLSIKDLKKLEFPTQHKHELLETLSIESSCDSLTSLPLVTFPNLRYLSIEKCENMEYLLVSGAESFKSLCYLLIYKCPNFVSFWREGLPAPNLITFSVWGSDKLKSLPDEMSTLLPKLEDLTISNCPEIESFPKRGMPPNLRRVEIVNCEKLLSGLAWPSMGMLTHLNVGGPCDGIKSFPKEGLLPPSLTSLSLYDLSNLEMLDCTGLLHLTSLQQLQIFGCPKLENMAGESLPFSLIKLTMVECPLLEKRCRMKHPQIWPKVSHIPGIKVGNRWI

SEQ ID NO: 13 - DNA, 3750 bp, Glycine max; identical to SEQ ID NO: 11
  CDS (1)..(3750)

SEQ ID NO: 14 - protein, 1249 aa, Glycine max; identical to SEQ ID NO: 12

SEQ ID NO: 15 - DNA, 3687 bp, Glycine max
  CDS (1)..(3687)
atggcagcagcactggtcggtggtgccttcctctctgcttttcttgatgtggttttcgacaggctggcttcacctgagtttgttgacttgatccgtggaaagaagcttagcaagaagttgcttcaaaagttggagaccactctcagagtggttggagctgtgcttgatgatgccgagaagaaacagatcacaaacaccaatgtcaaacactggctcaatgatctcaaacatgctgtctatgaagccgatgacttactcgaccatgttttcaccaaagctgccacccaaaacaaggtaagagacttgttttctcgcttttccgataggaagatcgttagtaagttggaggacatagttgtcacacttgagtctcatttaaaactcaaggagagtcttgatttgaaagagagtgcagtggagaacttgtcatggaaagctccatcaacatctctggaagatggatctcatatatatggtagggagaaagataaggaggccataatcaagttgttgtcggaggataacagtgacggtagagaagtgtctgtggttcctattgtgggcatgggtggggttggaaaaactactttggcccaattggtgtacaacgatgagaatttgaaacagatatttgattttgattttaaggcatgggtttgtgtttctcaagaatttgatgttctcaaggtcacaaaaactataatagaggcggtgactggaaaggcttgtaaattgaatgatctgaatctacttcatcttgaattgatggacaagctgaaagataaaaaattcttaattgttttggatgatgtttggacagaggattatgttgattggcgtcttcttaagaaaccatttaaccgtgggattattaggagaagtaaaattcttctaacaacccgcagtgaaaaaacagcatctgtagtccaaactgttcacacctatcatctaaaccaattgtcgaatgaagattgttggtcagtgtttgcgaaccatgcatgtctttccacggaatctaacgagaacacagcaacactagaaaaaattggaaaggagattgttaaaaagtgcaacggactgcctttagcagcagagtcgcttggaggcatgttgagaagaaagcatgacattggtgattggaataatattctcaatagtgacatttgggaactttctgaaagtgagtgtaaagttattccagcactgagacttagttatcattatctccctccacatttaaaacgatgctttgtttattgttcgttgtatccacaagattacgaatttgaaaaaaatgaattaatcttgttgtggatggctgaagatcttttgaagaaaccaaggaaaggtaggactttagaagaggttggtcatgagtattttgatgatttggtttcgagatcgtttttccaacgttcaagaacaagtagttggcctcatcgcaaatgttttgtgatgcatgacctcatgcatgatctagccacatcactcggtggagatttttattttagatcagaagaacttgggaaagaaacaaagatcaataccaagactcgtcatttgtcatttgccaaattcaattcttcagtcttggacaactttgatgttattggtagagcaaaatttctgagaaccttcttgtccattatcaattttgaagctgctccattcaacaatgaggaggcacaatgtatcataatgtcgaagcttatgtacttgagagttttatcattttgtgacttccaaagtctggattctttgcctgattcaataggtaaattgatccatctgcgctatttagatctctctttttcaagaatagaaacactgccaaagtcattgtgtaatttgtacaatctgcaaactttgaagttgtgtagttgcagaaagctgactaagttgcccagtgacatgcgcaatcttgttaacttgcgtcatcttggtattgcttatactcctataaaagagatgccgagaggaatgggtaaattaaatcatttacaacatctggatttctttgttgtgggcaagcacgaagagaatggaatcaaagaattgggaggactttcaaatcttcgtggtcagcttgaaattaggaagttggagaatgtttcccaaagtgatgaagcgttggaggcaaggatgatggataaaaaacacattaatagtttacagttggaatggtctggatgtaacaacaacagtaccaacttccaacttgaaatagatgtgctttgcaagttacagcctcactttaacattgaatcgttggaaataaaaggttatgaaggaaccagatttccagattggatgggaaattcttcctactgcaatatgattagtctaaaattgcgtgattgtcacaactgtagtatgcttccttcacttggacaactaccttctctcaaggaccttggaattgcacgattgaataggctgaagactattgatgcaggtttctacaagaatgaagaatgtcgttctgggacgtcctttccctcccttgaatctctgtccattgatgacatgccttgttgggaggtgtggagttccttcgattcagaagcttttcctgtgcttaacagtcttgaaatacgtgactgccccaaactagagggaagtttgccgaatcaccttcctgctctgacaaaacttgtgattagaaattgcgagctgcttgtctcttctctcccaacggctcccgccattcaaagtttggagatatgtaaaagcaataaagtagcactgcatgcgtttcctctcttggtagaaactatagaagtagaaggaagcccaatggtggagtccgtgatcgaggccatcactaacatccaaccaacttgtctccggtctttaacattaagggattgttcgtcagccgtgtcatttccgggtggtcgtttacctgaatcactgaagagtctgagtatcaaggatcttaaaaaactggaattcccgacgcaacacaaacatgagttactggaaacactgtcaatagaaagcagttgtgattcactcacatctcttccattggttacctttccaaatctcagagatcttgaaatcagaaactgtgaaaatatggaatctcttttggtatcattctggagagaaggattgcctgcgcccaacttgattactttccaagtgtggggctctgacaagttgaagtcgttgcctgatgagatgagtactcttctcccaaagttagaacgtctcctcatatccaactgcccagaaattgagtcctttccaaaacggggtatgccacctaacctgagaagagttgagattgtcaattgtgagaaactactgagcggcctagcatggccatccatgggcatgcttactcatctcaatgttgggggtccatgtgatggcatcaagtccttccctaaagagggtttgctgcctccctcccttacgtctctgtctctatatgacttgtcaaatctggagatgttggactgcacggggcttctccatctcacatccctgcaacaattacaaatttttggatgtccaaagctggagaatatggctggagaaagtcttcctttctctctaataaaattaaccatggtggaatgtcctttgctggaaaaacgatgccgcatgaagcaccctcaaatttggcctaaagtttcccacatccctggcattaaggttggcaatagatggatttag

SEQ ID NO: 16 - protein, 1228 aa, Glycine max
MAAALVGGAFLSAFLDVVFDRLASPEFVDLIRGKKLSKKLLQKLETTLRVVGAVLDDAEKKQITNTNVKHWLNDLKHAVYEADDLLDHVFTKAATQNKVRDLFSRFSDRKIVSKLEDIVVTLESHLKLKESLDLKESAVENLSWKAPSTSLEDGSHIYGREKDKEAIIKLLSEDNSDGREVSVVPIVGMGGVGKTTLAQLVYNDENLKQIFDFDFKAWVCVSQEFDVLKVTKTIIEAVTGKACKLNDLNLLHLELMDKLKDKKFLIVLDDVWTEDYVDWRLLKKPFNRGIIRRSKILLTTRSEKTASVVQTVHTYHLNQLSNEDCWSVFANHACLSTESNENTATLEKIGKEIVKKCNGLPLAAESLGGMLRRKHDIGDWNNILNSDIWELSESECKVIPALRLSYHYLPPHLKRCFVYCSLYPQDYEFEKNELILLWMAEDLLKKPRKGRTLEEVGHEYFDDLVSRSFFQRSRTSSWPHRKCFVMHDLMHDLATSLGGDFYFRSEELGKETKINTKTRHLSFAKFNSSVLDNFDVIGRAKFLRTFLSIINFEAAPFNNEEAQCIIMSKLMYLRVLSFCDFQSLDSLPDSIGKLIHLRYLDLSFSRIETLPKSLCNLYNLQTLKLCSCRKLTKLPSDMRNLVNLRHLGIAYTPIKEMPRGMGKLNHLQHLDFFVVGKHEENGIKELGGLSNLRGQLEIRKLENVSQSDEALEARMMDKKHINSLQLEWSGCNNNSTNFQLEIDVLCKLQPHFNIESLEIKGYEGTRFPDWMGNSSYCNMISLKLRDCHNCSMLPSLGQLPSLKDLGIARLNRLKTIDAGFYKNEECRSGTSFPSLESLSIDDMPCWEVWSSFDSEAFPVLNSLEIRDCPKLEGSLPNHLPALTKLVIRNCELLVSSLPTAPAIQSLEICKSNKVALHAFPLLVETIEVEGSPMVESVIEAITNIQPTCLRSLTLRDCSSAVSFPGGRLPESLKSLSIKDLKKLEFPTQHKHELLETLSIESSCDSLTSLPLVTFPNLRDLEIRNCENMESLLVSFWREGLPAPNLITFQVWGSDKLKSLPDEMSTLLPKLERLLISNCPEIESFPKRGMPPNLRRVEIVNCEKLLSGLAWPSMGMLTHLNVGGPCDGIKSFPKEGLLPPSLTSLSLYDLSNLEMLDCTGLLHLTSLQQLQIFGCPKLENMAGESLPFSLIKLTMVECPLLEKRCRMKHPQIWPKVSHIPGIKVGNRWI

SEQ ID NO: 17 - DNA, 3750 bp, Glycine max
  CDS (1)..(3750)
atggcagcagcactggtcggtggtgccttcctctctgcttttcttgatgtggttttcgacaggctggcttcacctgagtttgttgacttgatccgtggaaagaagcttagcaagaagttgcttcaaaagttggagaccactctcagagtggttggagctgtgcttgatgatgccgagaagaaacagatcacaaacaccaatgtcaaacactggctcaatgatctcaaacatgctgtctatgaagccgatgacttactcgaccatgttttcaccaaagctgccacccaaaacaaggtaagagacttgttttctcgcttttccgataggaagatcgttagtaagttggaggacatagttgtcacacttgagtctcatttaaaactcaaggagagtcttgatttgaaagagagtgcagtggagaacttgtcatggaaagctccatcaacatctctggaagatggatctcatatatatggtagggagaaagataaggaggccataatcaagttgttgtcggaggataacagtgacggtagagaagtgtctgtggttcctattgtgggcatgggtggggttggaaaaactactttggcccaattggtgtacaacgatgagaatttgaaacagatatttgattttgattttaaggcatgggtttgtgtttctcaagaatttgatgttctcaaggtcacaaaaactataatagaggcggtgactggaaaggcttgtaaattgaatgatctgaatctacttcatcttgaattgatggacaagctgaaagataaaaaattcttaattgttttggatgatgtttggacagaggattatgttgattggcgtcttcttaagaaaccatttaaccgtgggattattaggagaagtaaaattcttctaacaacccgcagtgaaaaaacagcatctgtagtccaaactgttcacacctatcatctaaaccaattgtcgaatgaagattgttggtcagtgtttgcgaaccatgcatgtctttccacggaatctaacgagaacacagcaacactagaaaaaattggaaaggagattgttaaaaagtgcaacggactgcctttagcagcagagtcgcttggaggcatgttgagaagaaagcatgacattggtgattggaataatattctcaatagtgacatttgggaactttctgaaagtgagtgtaaagttattccagcactgagacttagttatcattatctccctccacatttaaaacgatgctttgtttattgttcgttgtatccacaagattacgaatttgaaaaaaatgaattaatcttgttgtggatggctgaagatcttttgaagaaaccaaggaaaggtaggactttagaagaggttggtcatgagtattttgatgatttggtttcgagatcgtttttccaacgttcaagaacaagtagttggcctcatcgcaaatgttttgtgatgcatgacctcatgcatgatctagccaaatcactcggtggagatttttattttagatcagaagaacttgggaaagaaacaaagatcaataccaagactcgtcatttgtcatttgccaaattcaattcttcagtcttggacaactttgatgttattggtagagcaaaatttctgagaaccttcttgtccattatcaattttgaagctgctccattcaacaatgaggaggcacaatgtatcataatgtcgaagcttatgtacttgagagttttatcattttgtgacttccaaagtctggattctttgcctgattcaataggtaaattgatccatctgcgctatttagatctctctttttcaagaatagaaacactgccaaagtcattgtgtaatttgtacaatctgcaaactttgaagttgtgtagttgcagaaagctgactaagttgcctagtgacatgtgcaatcttgttaacttgcgtcatcttgagatacgtgaaactcctatagaagagatgccgagaggaatgagtaaattaaatcatctacaacatctggatttctttgttgtgggcaagcacgaagagaatggaatcaaagaattgggaggactttcaaatcttcgtggtcggcttgaaattaggaagttggagaatgtttcccaaagtgatgaagcgttggaggcaaggatgatggataaaaaacacattaatagtttacagttggaatggtctggatgtaacaacaacagtaccaacttccaacttgaaatagatgtgctttgcaagttacagcctcactttaacattgaatcgttggaaataaaaggttatgaaggaaccagatttccagattggatgggaaattcttcctactgcaatatgattagtctaaaattgcgtgattgtcacaactgtagtatgcttccttcacttggacaactaccttctctcaaggaccttggaattgcacgattgaataggctgaagactattgatgcaggtttctacaagaatgaagaatgtcgttctgggacgtcctttccctcccttgaatctctgtccattgatgacatgccttgttgggaggtgtggagttccttcgattcagaagcttttcctgtgcttaacagtcttgaaatacgtgactgccccaaactagagggaagtttgccgaatcaccttcctgctctgacaaaacttgtgattagaaattgcgagctgcttgtctcttctctcccaacggctcccgccattcaaagtttggagatatgtaaaagcaataaagtagcactgcatgcgtttcctctcttggtagaaactatagaagtagaaggaagcccaatggtggagtccgtgatcgaggccatcactaacatccaaccaacttgtctccggtctttaacattaagggattgttcgtcagccgtgtcatttccgggtggtcgtttacctgaatcactgaagagtctgagtatcaaggatcttaaaaaactggaattcccgacgcaacacaaacatgagttactggaaacactgtcaatagaaagcagttgtgattcactcacatctcttccattggttacctttccaaatctcagatatctcagcatcgaaaagtgtgaaaatatggaatatcttttggtttcaggggcagagtcatttaagagtctgtgttatttgttaatttacaaatgccccaactttgtatcattctggagagaaggattgcctgcgcccaacttgattactttccaagtgtggggctctgacaagttgaagtcgttgcctgatgagatgagtactcttctcccaaagttagaacgtctcctcatatccaactgcccagaaattgagtcgtttccaaaacggggtatgccacctaacctgagaatagtttggattttcaattgtgagaaactactgagcagcctagcatggccatccatgggcatgcttactcatctctatgttgggggtcgatgtgatggcatcaagtccttccctaaggagggtttgctgcctccctcccttacgtatctgtatctaagtggattctcaaatctggagatgttggactgcacggggcttctccatctcacatccctgcaacaattaaccatagacggatgtcctttgctggaaaatatggtgggagaaaggcttcctgactctctaataaaattaaccataaagagttgtcctttgctgaaaaaacgatgccggaagaagcaccctcaaatttggcctaaaatttcccacatccctggcattaaggttgacaatagatggatttag

SEQ ID NO: 18 - protein, 1249 aa, Glycine max
MAAALVGGAFLSAFLDVVFDRLASPEFVDLIRGKKLSKKLLQKLETTLRVVGAVLDDAEKKQITNTNVKHWLNDLKHAVYEADDLLDHVFTKAATQNKVRDLFSRFSDRKIVSKLEDIVVTLESHLKLKESLDLKESAVENLSWKAPSTSLEDGSHIYGREKDKEAIIKLLSEDNSDGREVSVVPIVGMGGVGKTTLAQLVYNDENLKQIFDFDFKAWVCVSQEFDVLKVTKTIIEAVTGKACKLNDLNLLHLELMDKLKDKKFLIVLDDVWTEDYVDWRLLKKPFNRGIIRRSKILLTTRSEKTASVVQTVHTYHLNQLSNEDCWSVFANHACLSTESNENTATLEKIGKEIVKKCNGLPLAAESLGGMLRRKHDIGDWNNILNSDIWELSESECKVIPALRLSYHYLPPHLKRCFVYCSLYPQDYEFEKNELILLWMAEDLLKKPRKGRTLEEVGHEYFDDLVSRSFFQRSRTSSWPHRKCFVMHDLMHDLAKSLGGDFYFRSEELGKETKINTKTRHLSFAKFNSSVLDNFDVIGRAKFLRTFLSIINFEAAPFNNEEAQCIIMSKLMYLRVLSFCDFQSLDSLPDSIGKLIHLRYLDLSFSRIETLPKSLCNLYNLQTLKLCSCRKLTKLPSDMCNLVNLRHLEIRETPIEEMPRGMSKLNHLQHLDFFVVGKHEENGIKELGGLSNLRGRLEIRKLENVSQSDEALEARMMDKKHINSLQLEWSGCNNNSTNFQLEIDVLCKLQPHFNIESLEIKGYEGTRFPDWMGNSSYCNMISLKLRDCHNCSMLPSLGQLPSLKDLGIARLNRLKTIDAGFYKNEECRSGTSFPSLESLSIDDMPCWEVWSSFDSEAFPVLNSLEIRDCPKLEGSLPNHLPALTKLVIRNCELLVSSLPTAPAIQSLEICKSNKVALHAFPLLVETIEVEGSPMVESVIEAITNIQPTCLRSLTLRDCSSAVSFPGGRLPESLKSLSIKDLKKLEFPTQHKHELLETLSIESSCDSLTSLPLVTFPNLRYLSIEKCENMEYLLVSGAESFKSLCYLLIYKCPNFVSFWREGLPAPNLITFQVWGSDKLKSLPDEMSTLLPKLERLLISNCPEIESFPKRGMPPNLRIVWIFNCEKLLSSLAWPSMGMLTHLYVGGRCDGIKSFPKEGLLPPSLTYLYLSGFSNLEMLDCTGLLHLTSLQQLTIDGCPLLENMVGERLPDSLIKLTIKSCPLLKKRCRKKHPQIWPKISHIPGIKVDNRWI

SEQ ID NO: 19 - DNA, 20 bp, Glycine max
cagctgccagaaacccacgt

SEQ ID NO: 20 - DNA, 20 bp, Glycine max
ctgcaccatcgtcaaccact

SEQ ID NO: 21 - DNA, 23 bp, Glycine max
ctaacaattgttacctctcttgc

SEQ ID NO: 22 - DNA, 18 bp, Glycine max
ctattgtgaggatgggtg

SEQ ID NO: 23 - DNA, 18 bp, Glycine max
cacccatcctcacaatag

SEQ ID NO: 24 - DNA, 24 bp, Glycine max
gggcatgggtgatgttggaaaaac

SEQ ID NO: 25 - DNA, 24 bp, Glycine max
gtttttccaacatcacccatgccc

SEQ ID NO: 26 - DNA, 24 bp, Glycine max
catgggtggggttagaaaaactac

SEQ ID NO: 27 - DNA, 24 bp, Glycine max
gtagtttttctaaccccacccatg

SEQ ID NO: 28 - DNA, 24 bp, Glycine max
catgggtggggttgagaaaactac

SEQ ID NO: 29 - DNA, 24 bp, Glycine max
gtagttttctcaaccccacccatg

SEQ ID NO: 30 - DNA, 24 bp, Glycine max
cagatatttgattctgattttaag

SEQ ID NO: 31 - DNA, 24 bp, Glycine max
cttaaaatcagaatcaaatatctg

SEQ ID NO: 32 - DNA, 23 bp, Glycine max
taaggcatgcgtttgtgtttctc

SEQ ID NO: 33 - DNA, 23 bp, Glycine max
gagaaacacaaacgcatgcctta

SEQ ID NO: 34 - DNA, 21 bp, Glycine max
catgggtttgtgcttctcaag

SEQ ID NO: 35 - DNA, 21 bp, Glycine max
cttgagaagcacaaacccatg

SEQ ID NO: 36 - DNA, 23 bp, Glycine max
ggtttgtgttcctcaagaatttg

SEQ ID NO: 37 - DNA, 23 bp, Glycine max
caaattcttgaggaacacaaacc

SEQ ID NO: 38 - DNA, 25 bp, Glycine max
cttaattgttttggctgatgtttgg

SEQ ID NO: 39 - DNA, 25 bp, Glycine max
ccaaacatcagccaaaacaattaag

SEQ ID NO: 40 - DNA, 22 bp, Glycine max
gttttggatggagtttggacag

SEQ ID NO: 41 - DNA, 22 bp, Glycine max
ctgtccaaactccatccaaaac

SEQ ID NO: 42 - DNA, 19 bp, Glycine max
cttctaacaatccgcagtg

SEQ ID NO: 43 - DNA, 19 bp, Glycine max
cactgcggattgttagaag

SEQ ID NO: 44 - DNA, 24 bp, Glycine max
gcagcagagttccttggaggcatg

SEQ ID NO: 45 - DNA, 24 bp, Glycine max
catgcctccaaggaactctgctgt

SEQ ID NO: 46 - DNA, 23 bp, Glycine max
cagagtcgcttagaggcatgttg

SEQ ID NO: 47 - DNA, 23 bp, Glycine max
caacatgcctctaagcgactctg

SEQ ID NO: 48 - DNA, 28 bp, Glycine max
catgacattggtaagtggaataatattc

SEQ ID NO: 49 - DNA, 28 bp, Glycine max
gaatattattccacttaccaatgtcatg

SEQ ID NO: 50 - DNA, 21 bp, Glycine max
gttatcattatttccctccac

SEQ ID NO: 51 - DNA, 21 bp, Glycine max
gtggagggaaataatgataac

SEQ ID NO: 52 - DNA, 29 bp, Glycine max
catttaaaacgatgctctgtttattgttc

SEQ ID NO: 53 - DNA, 29 bp, Glycine max
gaacaataaacagagcatcgttttaaatg

SEQ ID NO: 54 - DNA, 29 bp, Glycine max
catttaaaacgatgccttgtttattgttc

SEQ ID NO: 55 - DNA, 29 bp, Glycine max
gaacaataaacaaggcatcgttttaaatg

SEQ ID NO: 56 - DNA, 25 bp, Glycine max
caaatgttttgtggtgcatgacctc

SEQ ID NO: 57 - DNA, 25 bp, Glycine max
gaggtcatgcaccacaaaacatttg

SEQ ID NO: 58 - DNA, 25 bp, Glycine max
gtgatgcatggtctcatgcatgatc

SEQ ID NO: 59 - DNA, 25 bp, Glycine max
gatcatgcatgagaccatgcatcac

SEQ ID NO: 60 - protein, 478 aa, Glycine max
FDRLASPEFVDLIRGKKLSKKLLQKLETTLRVVGAVLDDAEKKQITNTNVKHWLNDLKHAVYEADDLLDHVFTKAATQNKVRDLFSRFSDRKIVSKLEDIVVTLESHLKLKESLDLKESAVENLSWKAPSTSLEDGSHIYGREKDKEAIIKLLSEDNSDGREVSVVPIVGMGGVGKTTLAQLVYNDENLKQIFDFDFKAWVCVSQEFDVLKVTKTIIEAVTGKACKLNDLNLLHLELMDKLKDKKFLIVLDDVWTEDYVDWRLLKKPFNRGIIRRSKILLTTRSEKTASVVQTVHTYHLNQLSNEDCWSVFANHACLSTESNENTATLEKIGKEIVKKCNGLPLAAESLGGMLRRKHDIGDWNNILNSDIWELSESECKVIPALRLSYHYLPPHLKRCFVYCSLYPQDYEFEKNELILLWMAEDLLKKPRKGRTLEEVGHEYFDDLVSRSFFQRSRTSSWPHRKCFVMHDLMHDLATS

SEQ ID NO: 61 - protein, 479 aa, Glycine max
FDRLASPDFVDLILGKKLSKKLLRKLETTLRVVGAVLDDAEKKQITNTNVKHWLNALKDAVYEADDLLDHVFTKAATQNKVRNLFSRFSDRKIVSKLEDIVVTLESHLKLKESLDLKESAVENLSWKAPSTSLEDGSHIYGREKDREAIIKLLSEDNSDGSEVSVVPIVGMGGVGKTTLAQLVYNDENLKEKFDFDFKAWVCVSQEFDVLKVTKTIIQAVTGNPCKLNDLNLLHLELMDKLKDKKFLIVLDDVWTEDYVDWSLLKKPFQCGIIRRSKILLTTRSEKTASVVQTVQTYHLNQLSNEDCWSVFANHACLSLESNENTTLEKIGKEIVKKCDGLPLAAQSLGGMLRRKHDIGDWYNILNSDIWELSESECKVIPALRLSYHYLPPHLKRCFVYCSLYPQDYEFDKNELILLWMAEDLLKKPRKGRTLEEVGHEYFDDLVSRSFFQRSSTNRSSWPYGECFVMHDLMHDLAKS

SEQ ID NO: 62 - protein, 454 aa, Glycine max
FDRLAPNGDLLNMFRKHKDHVKLLKKLKMTLRGIQIVLSDAENKQASNPSVRDWLNELRDAVDSAENLIEEVNYEALRLKVEGQHQNFSETSNQQVSDEFFLNIKDKLEDTIETLKDLQEQIGLLGLKEYFDSTKLETRTPSTSLIDEPDIFGRQSEIEDLIDRLLSEGASGKNLTVVPIVGMGGLGKTTLAKAVYNDESVKNHFDLKAWFCVSEAYNAFRITKGLLQEIGSIDLVDDNLNQLQVKLKERLKEKKFLIVLDDVWNDNYNEWDELRNVFVQGDIGSKIIVTTRKDSVALMMGNEQISMGNLSTEASWSLFQRHAFENMDPMGHSELEEVGRQIAAKCKGLPLALKTLAGMLRSKSEVEEWKCILRSEIWELRDNDILPALMLSYNDLPAHLKRCFSFCAIFPKDYPFRKEQVIHLWIANGLVPVEDEIIQDLGNQFFLELSSRSL

SEQ ID NO: 63 - protein, 489 aa, Glycine max
FDRLAPNGDLLNMFRKHTDDVELFEKLGDILLSLQIVLSDAENKKASNQFVSQWLHKLQTAVDAAENLIEQVNYEALRLKVETSNQQVSDLNLCLSDDFFLNIKKKLEDTIKKLEVLEKQIGRLGLKEHFISTKQETRTPSTSLVDDSGIFGRKNEIENLVGRLLSMDTKRKNLAVVPIVGMGGMGKTTLAKAVYNDERVQKHFGLTAWFCVSEAYDAFRITKGLLQEIGSTDLKADDNLNQLQVKLKADDNLNQLQVKLKEKLNGKRFLVVLDDVWNDNYPEWDDLRNLFLQGDIGSKIIVTTRKESVALMMDSGAIYMGILSSEDSWALFKRHSLEHKDPKEHPEFEEVGKQIADKCKGLPLALKALAGMLRSKSEVDEWRNILRSEIWELPSCSNGILPALMLSYNDLPAHLKQCFAYCAIYPKDYQFRKEQVIHLWIANGLVHQFHSGNQYFIELRSRSLFEMASEPSERDVEEFLMHDLVNDLA

SEQ ID NO: 64 - protein, 450 aa, Glycine max
MAYAAVTSLMRTIHQSMELTGCDLQPFYEKLKSLRAILEKSCNIMGDHEGLTILEVEIVEVAYTTEDMVDSESRNVFLAQNLEERSRAMWEIFFVLEQALECIDSTVKQWMATSDSMKDLKPQTSSLVSLPEHDVEQPENIMVGRENEFEMMLDQLARGGRELEVVSIVGMGGIGKTTLATKLYSDPCIMSRFDIRAKATVSQEYCVRNVLLGLLSLTSDEPDDQLADRLQKHLKGRRYLVVIDDIWTTEAWDDIKLCFPDCYNGSRILLTTRNVEVAEYASSGKPPHHMRLMNFDESWNLLHKKIFEKEGSYSPEFENIGKQIALKCGGLPLAITVIAGLLSKMGQRLDEWQRIGENVSSVVSTDPEAQCMRVLALSYHHLPSHLKPCFLYFAIFTEDEQISVNELVELWPVEGFLNEEEGKSIEEVATTCINELIDRSLIFIHNFSFR

SEQ ID NO: 65 - DNA, 26 bp, Glycine max
caagtggattgatgtgatatctccac

SEQ ID NO: 66 - DNA, 34 bp, Glycine max
cgggatcccgttcgtaaatggtgaaaattttcag

SEQ ID NO: 67 - DNA, 29 bp, Glycine max
cgcggatcctctcaacaatctagctagag

SEQ ID NO: 68 - DNA, 40 bp, Glycine max
cgaatgagctcccgggaggcctaagacgtgctcaaatcac

SEQ ID NO: 69 - protein, 11 aa, Glycine max
CCNBSLRRARC

SEQ ID NO: 70 - DNA, 1056 bp, Glycine max
  CDS (1)..(1056)
aaagctccatcaacatctctggaagatggatctcatatatatggtagggagaaagataaggaggccataatcaagttgttgtcggaggataacagtgacggtagagaagtgtctgtggttcctattgtgggcatgggtggggttggaaaaactactttggcccaattggtgtacaacgatgagaatttgaaacagatatttgattttgattttaaggcatgggtttgtgtttctcaagaatttgatgttctcaaggtcacaaaaactataatagaggcggtgactggaaaggcttgtaaattgaatgatctgaatctacttcatcttgaattgatggacaagctgaaagataaaaaattcttaattgttttggatgatgtttggacagaggattatgttgattggcgtcttcttaagaaaccatttaaccgtgggattattaggagaagtaaaattcttctaacaacccgcagtgaaaaaacagcatctgtagtccaaactgttcacacctatcatctaaaccaattgtcgaatgaagattgttggtcagtgtttgcgaaccatgcatgtctttccacggaatctaacgagaacacagcaacactagaaaaaattggaaaggagattgttaaaaagtgcaacggactgcctttagcagcagagtcgcttggaggcatgttgagaagaaagcatgacattggtgattggaataatattctcaatagtgacatttgggaactttctgaaagtgagtgtaaagttattccagcactgagacttagttatcattatctccctccacatttaaaacgatgctttgtttattgttcgttgtatccacaagattacgaatttgaaaaaaatgaattaatcttgttgtggatggctgaagatcttttgaagaaaccaaggaaaggtaggactttagaagaggttggtcatgagtattttgatgatttggtttcgagatcgtttttccaacgttcaagaacaagtagttggcctcatcgcaaatgttttgtgatgcatgacctcatgcatgatctagccacatca

SEQ ID NO: 71 - protein, 352 aa, Glycine max
KAPSTSLEDGSHIYGREKDKEAIIKLLSEDNSDGREVSVVPIVGMGGVGKTTLAQLVYNDENLKQIFDFDFKAWVCVSQEFDVLKVTKTIIEAVTGKACKLNDLNLLHLELMDKLKDKKFLIVLDDVWTEDYVDWRLLKKPFNRGIIRRSKILLTTRSEKTASVVQTVHTYHLNQLSNEDCWSVFANHACLSTESNENTATLEKIGKEIVKKCNGLPLAAESLGGMLRRKHDIGDWNNILNSDIWELSESECKVIPALRLSYHYLPPHLKRCFVYCSLYPQDYEFEKNELILLWMAEDLLKKPRKGRTLEEVGHEYFDDLVSRSFFQRSRTSSWPHRKCFVMHDLMHDLATS

SEQ ID NO: 72 - DNA, 18 bp, Glycine max
ctattgtgaggatgggtg

SEQ ID NO: 73 - DNA, 18 bp, Glycine max
cacccatcctcacaatag

SEQ ID NO: 74 - DNA, 24 bp, Glycine max
catgggtggggttgagaaaactac

SEQ ID NO: 75 - DNA, 24 bp, Glycine max
gtagttttctcaaccccacccatg

SEQ ID NO: 76 - DNA, 24 bp, Glycine max
cagatatttgattctgattttaag

SEQ ID NO: 77 - DNA, 24 bp, Glycine max
cttaaaatcagaatcaaatatctg

SEQ ID NO: 78 - DNA, 23 bp, Glycine max
taaggcatgcgtttgtgtttctc

SEQ ID NO: 79 - DNA, 23 bp, Glycine max
gagaaacacaaacgcatgcctta

SEQ ID NO: 80 - DNA, 21 bp, Glycine max
catgggtttgtgcttctcaag

SEQ ID NO: 81 - DNA, 21 bp, Glycine max
cttgagaagcacaaacccatg

SEQ ID NO: 82 - DNA, 23 bp, Glycine max
ggtttgtgttcctcaagaatttg

SEQ ID NO: 83 - DNA, 23 bp, Glycine max
caaattcttgaggaacacaaacc

SEQ ID NO: 84 - DNA, 25 bp, Glycine max
cttaattgttttggctgatgtttgg

SEQ ID NO: 85 - DNA, 25 bp, Glycine max
ccaaacatcagccaaaacaattaag

SEQ ID NO: 86 - DNA, 22 bp, Glycine max
gttttggatggagtttggacag

SEQ ID NO: 87 - DNA, 22 bp, Glycine max
ctgtccaaactccatccaaaac

SEQ ID NO: 88 - DNA, 24 bp, Glycine max
gcagcagagttccttggaggcatg

SEQ ID NO: 89 - DNA, 24 bp, Glycine max
catgcctccaaggaactctgctgt

SEQ ID NO: 90 - DNA, 28 bp, Glycine max
catgacattggtaagtggaataatattc

SEQ ID NO: 91 - DNA, 28 bp, Glycine max
gaatattattccacttaccaatgtcatg

SEQ ID NO: 92 - DNA, 21 bp, Glycine max
gttatcattatttccctccac

SEQ ID NO: 93 - DNA, 21 bp, Glycine max
gtggagggaaataatgataac

SEQ ID NO: 94 - DNA, 29 bp, Glycine max
catttaaaacgatgctctgtttattgttc

SEQ ID NO: 95 - DNA, 29 bp, Glycine max
gaacaataaacagagcatcgttttaaatg

SEQ ID NO: 96 - DNA, 25 bp, Glycine max
caaatgttttgtggtgcatgacctc

SEQ ID NO: 97 - DNA, 25 bp, Glycine max
gaggtcatgcaccacaaaacatttg

SEQ ID NO: 98 - DNA, 25 bp, Glycine max
gtgatgcatggtctcatgcatgatc

SEQ ID NO: 99 - DNA, 25 bp, Glycine max
gatcatgcatgagaccatgcatcac

SEQ ID NO: 100 - DNA, 24 bp, Glycine max
catgggtggggttggaaaaactac

SEQ ID NO: 101 - DNA, 24 bp, Glycine max
gtagtttttccaaccccacccatg

SEQ ID NO: 102 - DNA, 21 bp, Soybean
catgggtttgtgtttctcaag

SEQ ID NO: 103 - DNA, 21 bp, Glycine max
cttgagaaacacaaacccatg

SEQ ID NO: 104 - DNA, 25 bp, Glycine max
cttaattgttttggatgatgtttgg

SEQ ID NO: 105 - DNA, 25 bp, Glycine max
ccaaacatcatccaaaacaattaag

SEQ ID NO: 106 - DNA, 21 bp, Glycine max
gttatcattatctccctccac

SEQ ID NO: 107 - DNA, 21 bp, Glycine max
gtggagggagataatgataac

SEQ ID NO: 108 - DNA, 29 bp, Glycine max
catttaaaacgatgctttgtttattgttc

SEQ ID NO: 109 - DNA, 29 bp, Glycine max
gaacaataaacaaagcatcgttttaaatg

SEQ ID NO: 110 - protein, 32 aa, Glycine max
MAAALVGGAFLSAFLDVVFDRLASPEFVDLIR

SEQ ID NO: 111 - protein, 112 aa, Glycine max
GKKLSKKLLQKLETTLRVVGAVLDDAEKKQITNTNVKHWLNDLKHAVYEADDLLDHVFTKAATQNKVRDLFSRFSDRKIVSKLEDIVVTLESHLKLKESLDLKESAVENLSW

SEQ ID NO: 112 - protein, 352 aa, Glycine max; identical to SEQ ID NO: 71

SEQ ID NO: 113 - protein, 75 aa, Glycine max
LGGDFYFRSEELGKETKINTKTRHLSFAKFNSSVLDNFDVIGRAKFLRTFLSIINFEAAPFNNEEAQCIIMSKLM

SEQ ID NO: 114 - protein, 24 aa, Glycine max
YLRVLSFCDFQSLDSLPDSIGKLI

SEQ ID NO: 115 - protein, 23 aa, Glycine max
HLRYLDLSFSRIETLPKSLCNLY

SEQ ID NO: 116 - protein, 24 aa, Glycine max
NLQTLKLCSCRKLTKLPSDMRNLV

SEQ ID NO: 117 - protein, 23 aa, Glycine max
NLRHLGIAYTPIKEMPRGMGKLN

SEQ ID NO: 118 - protein, 25 aa, Glycine max
HLQHLDFFVVGKHEENGIKELGGLS

SEQ ID NO: 119 - protein, 29 aa, Glycine max
NLRGQLEIRKLENVSQSDEALEARMMDKK

SEQ ID NO: 120 - protein, 33 aa, Glycine max
HINSLQLEWSGCNNNSTNFQLEIDVLCKLQPHF

SEQ ID NO: 121 - protein, 25 aa, Glycine max
NIESLEIKGYEGTRFPDWMGNSSYC

SEQ ID NO: 122 - protein, 23 aa, Glycine max
NMISLKLRDCHNCSMLPSLGQLP

SEQ ID NO: 123 - protein, 33 aa, Glycine max
SLKDLGIARLNRLKTIDAGFYKNEECRSGTSFP

SEQ ID NO: 124 - protein, 25 aa, Glycine max
SLESLSIDDMPCWEVWSSFDSEAFP

SEQ ID NO: 125 - protein, 22 aa, Glycine max
VLNSLEIRDCPKLEGSLPNHLP

SEQ ID NO: 126 - protein, 21 aa, Glycine max
ALTKLVIRNCELLVSSLPTAP

SEQ ID NO: 127 - protein, 20 aa, Glycine max
AIQSLEICKSNKVALHAFPL

SEQ ID NO: 128 - protein, 26 aa, Glycine max
LVETIEVEGSPMVESVIEAITNIQPT

SEQ ID NO: 129 - protein, 23 aa, Glycine max
CLRSLTLRDCSSAVSFPGGRLPE

SEQ ID NO: 130 - protein, 22 aa, Glycine max
SLKSLSIKDLKKLEFPTQHKHE

SEQ ID NO: 131 - protein, 23 aa, Glycine max
LLETLSIESSCDSLTSLPLVTFP

SEQ ID NO: 132 - protein, 28 aa, Glycine max
NLRDLEIRNCENMESLLVSFWREGLPAP

SEQ ID NO: 133 - protein, 25 aa, Glycine max
NLITFQVWGSDKLKSLPDEMSTLLP

SEQ ID NO: 134 - protein, 23 aa, Glycine max
KLERLLISNCPEIESFPKRGMPP

SEQ ID NO: 135 - protein, 23 aa, Glycine max
NLRRVEIVNCEKLLSGLAWPSMG

SEQ ID NO: 136 - protein, 25 aa, Glycine max
MLTHLNVGGPCDGIKSFPKEGLLPP

SEQ ID NO: 137 - protein, 25 aa, Glycine max
SLTSLSLYDLSNLEMLDCTGLLHLT

SEQ ID NO: 138 - protein, 23 aa, Glycine max
SLQQLQIFGCPKLENMAGESLPF

SEQ ID NO: 139 - protein, 23 aa, Glycine max
SLIKLTMVECPLLEKRCRMKHPQ

SEQ ID NO: 140 - protein, 7 aa, Glycine max
  misc_feature (1)..(2): Xaa can be any naturally occurring amino acid
  misc_feature (4)..(4): Xaa can be any naturally occurring amino acid
  misc_feature (6)..(7): Xaa can be any naturally occurring amino acid
XXLXLXX

SEQ ID NO: 141 - protein, 25 aa, Glycine max
NLRYLSIEKCENMEYLLVSGAESFK

SEQ ID NO: 142 - protein, 24 aa, Glycine max
SLCYLLIYKCPNFVSFWREGLPAP

SEQ ID NO: 143 - protein, 25 aa, Glycine max
NLITFSVWGSDKLKSLPDEMSTLLP

SEQ ID NO: 144 - protein, 23 aa, Glycine max
KLEDLTISNCPEIESFPKRGMPP

SEQ ID NO: 145 - protein, 18 aa, Glycine max
IWPKVSHIPGIKVGNRWI

SEQ ID NO: 146 - DNA, 36 bp, Glycine max
ctatataataaaaaaataaaaataaaaaagaccata

SEQ ID NO: 147 - DNA, 9 bp, Glycine max
tcgtcctgc

SEQ ID NO: 148 - DNA, 196 bp, Glycine max
ttccctgcgaccagttgagcttccacatgccgagttggtccgtggctatatagaatgtgatagtctgttcatgattagacggagacaggaacctgataagcaggtaagtctcgccagatacacatgcaagactatcgtgaaagcccaagcgctgttgtatggaaaggacaccagactttatgggaaaaagtagaaa

SEQ ID NO: 149 - DNA, 168 bp, Glycine max
actgggaacgaataacctcggggtcaccaattcaactgcaacggtacaaagacccaccgactaaccttaagccgttgcttagtgttatttgttaatttacaaatgccccaactttgtagttgaaccggaggacacctaacgcaattttaaagcttttggtgaagctgg

SEQ ID NO: 150 - DNA, 79 bp, Glycine max
gctacatactgctttatctgaaatatatcagtaaaaattttagcctaagaactgagtatagataactcgtgtagtcgaa

SEQ ID NO: 151 - DNA, 60 bp, Glycine max
tgcgtcaactcctaaaaggcactattttaggcctcagacgcgagccgggacacgccgagg

SEQ ID NO: 152 - DNA, 64 bp, Glycine max
tacgtgcgtcaactcctaaaaggcactattttaggcctcagacgcgagccgggacacgccgagg

SEQ ID NO: 153 - DNA, 595 bp, Glycine max
tctaataaaattaaccatggtggaatgtcctttgctggaaaaacgatgccgcatgaagcaccctcaaatttggcctaaagtttcccacatccctggcattaaggttggcaatagatggatttagccaccaaggaggaccaacaggtatcttctaagtctaaccaactagaaaactatttctgtcaaggatatgtttcatttcatgtctttctacttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgacaaatacttaaatataatgattctccggaaaaatgttacacatcagtgttgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaattt

SEQ ID NO: 154 - DNA, 595 bp, Glycine max
tctaataaaattaaccataaagagttgtcctttgctgaaaaaacgatgccggaagaagcaccctcaaatttggcctaaaatttcccacatccctggcattaaggttgacaatagatggatttagccaccaaggaggaccaacaggtatcttctaagtctaaccaactagaaaactagttctgtcaaggatatgtttcatttcatgtctttctccttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgataaatacttaaatataatgattctccggaaaaatgttacacatcagtattgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaattt

SEQ ID NO: 155 - DNA, 301 bp, Glycine max
tctaataaaattaacaataaagagatgtcctttgctggaaaaacgatgccggaagaagcaccctcaaatttggcctaaaatttcccacatccctggcattcaggttgatgatagatggatttagccaccaaggatgaccaacagagaatcaacaaatcatcaaaggcaacgtggaaattgaccttgtatatatgtttcgaagaagtaacgaaacagatatggttgattgacccggagaaactgtacctacccatgaatctaagttcaaatttgaactagtgctaaatgtaacttttaattt

SEQ ID NO: 156 - DNA, 301 bp, Glycine max
tctaataaaattaaccatagtgagttgtcctttgctggaaatacgatgccgcatgaagcaccctcaaatttggcctaaaatttcccacatccctggcattcaggttgacgatagatggatttagccaccaaggatgaccaacagagaatcaacaaatcatcaaaggcaacgtggaaattgaccttgtatatatgtttcgaagaagtaacgatacagatatggttgattggcccggagaaattgtacctacccatgaatctaagttcaaatttgaactagtgctaaatgtaacttttaattt

SEQ ID NO: 157 - DNA, 301 bp, Glycine max
tctaataaaattaaccatatgggaatgtcctttgctggaaaaacgatgccgcatgaagcaccctcaaatttggcctaaaatttcccacatccctggcattaaggttgacgatagatggatttagccaccaaggatgatcatcagagaatcaacaaatcatcaaaggcaacgtggaaattgaccttgtatatatgtttagaagaagtaacgatacagatatggttgattggcccggagaaactgtacctatccatgaatctaagttcaaatttgaactagtgctaaatgtaacttttgattt

SEQ ID NO: 158 - DNA, 420 bp, Glycine max
tctaataaaattaaccatattggaatgtcctttgctggaaaaacaatgccgcatgaagcaccctcaaatttaatctggcctaaaatttgccacatccctggcattcaggttgacgatagatggatttagccaccaaggatgaccaacagagaatcaacaaattatcaaaggcaacttgtgatatcatctaaatcaaattcactgaagagtgccgcttaacccctagcttcgaagaagtaacgatacaggtactaagtaacaacattgataaatacttaaatataatgatacaggtactaagtaacaacattgataaacttatttttgtttttcagatatggttgattggtccgaagaaactgtacctacccatgaatctaagtttaaatttgaactagtgctaaatgtaacttttgattt

SEQ ID NO: 159 - DNA, 912 bp, Glycine max
tcactgaatatattaataataaaatttttatataaataagattcaaaggataatcaccaaccaagaaattttatggaagtatttatcaaataattacaatagatatataacataaaaaaaagagttgaattgaataataatttttcatgccatcatttcaaaagaattactttaatcactctctttatattattattattattattataacatcttcacaatattttttattttattagtatttattgattttatttaataaaaaatcacacacttttctttttgcacacatctttaatctacatataaggatattcaaatcttgacttcattaatatatattattgtttttagggatcaattagcatgtgtcttttctttaattctttctcttttaatttgttcaacatcttttattgtgttaataattttttaatctcatttttttattttcctcctaacaaaatttattctatatataagaattaataaagatttaaatcttttaccacttgattaaaaaacataaattactatcaattattttaactttttataaaatcatgattcagatctttatacaataacatatctcatcatgtgttagttgtttatatcatcactctttaaatctcttgagtctttagtttagaggagctaaattcaaaatagaaatatcaagaaagtaacatatgtgaggatcaaaagtaaagagactcccaacgtgataagtcacccaccaccataataatacaaataataaaaataaaaaagaccatacttttgtcttgcacagcagaacgagtgaaggtgaagagagttgacttaagccaaatctcatcacatcagttcatagcaaccaattcccttgcctttgtctttctactctgatcatcttttgttcttgagata

SEQ ID NO: 160 - DNA, 2199 bp, Glycine max
ccaccaaggaggaccaacaggtatcttctaagtctaaccaactagaaaactagttctgtcaaggatatgtttcatttcatgtctttctccttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgataaatacttaaatataatgattctccggaaaaatgttacacatcagtattgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgacgtcaaattgacactttctcaatagctaaatttttatttgtgaggttttttgttaggtacaatgtgaaggatgaaaaggtgtaccaagtgaactttagaaggattggatgatttcagcttatctcttatctcctgtcctataaattaatagtggtatgattattctaaaaatatgatagatatgtagatacgtaagaattgataaaagcataataaatatacaattgcaattcggtaaattgaagaacatacatacttcttagacattgctaaaaacaaaatcaaaaaattgtagatcattttttcctattgttcacaaataagaatggtactatcaatgatcaatctcatttctttcttgaaattatctataaacaaaacaattttcatatttggttcatcaagaaacaatactttttatatttctatattatatttacttctatgttacatgtcactatatttgattatcataatttttttttaaaagaattggtcactttacatatatgtaccagtgaaatatatcaatatattggtatcggatatagatgcatgaagcaaattaaagtatcagtactttgtagcaaaacacattcttcaaatcatgacatgaggtaaaaaaatatgatgatatttttgtaagtattggaaaaaaaaaaaaaagtaaagcttctgaaatcaaagagacactaattttccacaacatccttcaattgggcccaagcttcctttcctattgacaaataactggttgttagtgccagctttttcttttttctagttttccattgatggttaaaagctaatatgaacctgtcactccttaaaatttccaccaaagtttggtaaataaatatataggagagtgaataatgcaagccttgcattctatctctaagttactaggtatatgaaacaggtatgggtatggttttagaaggtatgtggttcatcactatttatatttttactacaagaaccaggtaaactttattatggtacagtaaatttagtgtgaggttgtaactacgttatatccatctaacttagcacgataattaaatttaaaagcaaaaagataagaaaaaggccaatctaacaattgttacctctcttgcatgaaaaaatcagaaacaaaagccccactctttcctccatggtgcctgtaattaacaagcacttcaaaaatcaatgttaattaattaatttccataagaaaaaaaagacagaagctaatgaaatttaaggggtacaacaaagatttgtagaacgatcattaatattagtgcaacacatcatgatgaagtgcatgacataataataatgtgaaaccaatcatgataagaacagaaaataaatcagtgcaattacatgattagaaaataaagaggcgatatatcatattcctattgatcagacaatatgacaacgtgttaaacaaatgtgtcaggtgcaataatgaggggatagagaagagaaggatgataaagaatgtggttatgacttctacaaagtcgaattatttacttttttaattttttatattttccttttcacttttctaatagttgtccgattaagaggagtttatagagtagattaaattggttttgaaaaagagaaatatcatcttatacaatttttggttttcttaattcattgttcaattgatgtagtttaaaatttaaatatgatttaataagtttggattgatctcga

SEQ ID NO: 161 - DNA, 569 bp, Glycine max
tttacataacttttggatttaacaaaaaaattcattttcaattttactattaacttattttttaaataaaaatatccaaaacacatgtgcaaactgcttcaatacaacttgtctcacagcatcaaagcacaggaacataattatgcacagtacccttgcagccatccacacatatcaccaagaaaaaaacacacaccactgctccacacggtttggaaagcgagaaagctggccatcactaactttaattatagcattttagaaatataatccatttttttaaaattaacggtagaaatatcatcactctttaaatctcttgagtctttagtttagaggagctaaatttaaaatagaaatatcaagaaagcaacatgtggggatcaaaagtaaagagactcccaacgtgataagtcacccaccaccaattcccttgccttttgtcttgcacagcagaacgagtgaaggtgaagagagttgacttaagccaaatctcatcacatcagttcatagcaaccaattcccttgcctttgtctttctactctgatcatcttttgttcttgagata

SEQ ID NO: 162 - DNA, 2198 bp, Glycine max
ccaccaaggaggaccaacaggtatcttctaagtctaaccaactagaaaactatttctgtcaaggatatgtttcatttcatgtctttctacttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgacaaatacttaaatataatgattctccggaaaaatgttacacatcagtgttgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgatgtcaaattgacactttctcaatagctgaatttttatttgtgaggtttttcgttgggtacaatgtgaaggatgaaaaggtgtaccaagtgaactttagaaggattggatgatttcagcttatctcttattccctgtcctataaattaataatggtatgattattctaaaaatatgatagatatgtagataagtaagaattgataaaagcataataaatatacaattgcaattcggtaaactgaagaacatacatacttcttagacattgctaaaaacaaaatcaaaaaattgtagatcatttttttcctattgttcacaaataagaatggtactatcaatgatcaatctcatttctttcttgaaattatctataaacaaaacaattttcatattggttcatcaagaaacaatactttttatatttctatattatacttacttctatgttacatgtcactatatttgattatcataatttttttttaaagaattggtcacttcacatatatgtatcagatatattggtatcagatatagatgcatgaagcaaattaaagtatcagtactttgtagcaaaacacattcttcaaatcatgacatgaggtaaaaaaaaataagatgatatttttgtaagtattggaaaaaaaaagagtaaagcttctgaaatcaaagagacactaattttccacaacatccttcaattgggcccaagcttcctttcctatggacaaataactggttgttagtgccagccttttctttttaccagttttccattgatggttaaaagctattatgaacctgtcactccttaaaatttccaccaaagtttggtaaataaatatataggagagtgaataatacaagtcttgcattctatctctaagttattaggtatatgaaacaggtatgggtatttggttttagaaggtatgtggttcatcactatttatattattactacaagaaccaggtaaactttattatggtacagtaagtttggtgtgagttgtaactacgttatatccatctcacttagcacgataattaaatttaaaagcaaaaagataagaaaaaggccaatctaacaattgttacctctcttgcatgacaaaatcagaaacaaaagtcccactctttcctccatggtgcctgtaattaacaagcacttcaaaaaccaatgttaattaattaatttccataaaaaaaaaaaggcaaaagccaatgaaatttaaggggtacaacaaagatttgtagaacgatcattaatattagtgcaacgcaccatgatgaagtgcatgacataataataatgtggaaccaatcatgataagaacagaaaataaatcaatgcaattgcatgatcagaaaataacgaggcgatatatcatgttcctattgatagacaataggacaacgtgttaaagaaatgtgtcaagtgcaacaatgagggaacggagaagagaaggatgataaagaatgtggttatgacttctacaaagtccaattatttacttttttaattttttatattttccttttcactttcctaatagttgtcggattaaaaggagtttatggagtagattagattggttttgaaaaagagaaatatcatctgatacaatttttagttttcttaatttattgttcaattgatgtagtttaaaaagttgcactaactgaagtggaaaaggaacataggttggcataatggaat

SEQ ID NO: 163 - DNA, 1309 bp, Glycine max
acttctctctgcaagctaaaaaggagtgttgtttaggaaacaattttgaggcaggtgtattttggaaaaaatgaggagagagcaagtgtagtggagtaaaaaaatcctgtaaggttttgtttggtagtaaaaagaaaaaaataattgtaatgagaaaaaataagttagaggataaatatcttcaacacttaaacaaacaaataaaaaagtttttctaggaagttcacttaaatctattttaactattgataaaaatttatacctgttgatttaaaataaaattatatttattaaatatgataggagaaaaaatattttttacatatagtaaaatattttcatttgctgaacttaaattttctttatctctcattttactattgttgtttgagatgatctcactgaatatattaataataaaatttttatataaataagattcaaaggataatcaccaaccaagaaattttatggaagtatttatcaaataattacaatagatatataacataaaaaaaagagttgaattgaataataatttttcatgccatcatttcaaaagaattactttaatcactctctttatattattattattattattataacatcttcacaatattttttattttattagtatttattgattttatttaataaaaaatcacacacttttctttttgcacacatctttaatctacatataaggatattcaaatcttgacttcattaatatatattattgtttttagggatcaattagcatgtgtcttttctttaattctttctcttttaatttgttcaacatttttattgtgttaataattttttaatctcatttttttattttcctcctaacaaaatttattctatatataagaattaataaagatttaaatcttttaccacttgattaaaaaacataaattactatcaattattttaactttttataaaatcatgattcagatctttatacaataacatatctcatcatgtgttagttgtttatatcatcactctttaaatctcttgagtctttagtttagaggagctaaattcaaaatagaaatatcaagaaagtaacatatgtgaggatcaaaagtaaagagactcccaacgtgataagtcacccaccaccataataatacaaataataaaaataaaaaagaccatacttttgtcttgcacagcagaacgagtgaaggtgaagagagttgacttaagccaaatctcatcacatcagttcatagcaaccaattcccttgcctttgtctttctactctgatcatcttttgttcttgagata

SEQ ID NO: 164 - DNA, 2143 bp, Glycine max
ccaccaaggaggaccaacaggtatcttctaagtctaaccaactagaaaactagttctgtcaaggatatgtttcatttcatgtctttctccttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgataaatacttaaatataatgattctccggaaaaatgttacacatcagtattgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgatgtcaaattgacactttctcaatagctgaatttttatttgtgaggtttttcgttgggtacaatgtgaaggatgaaaaggtgtaccaagtgaactttagaaggattggatgatttcagcttatctcttattccctgtcctataaattaataatggtatgattattctaaaaatatgatagatatgtagataagtaagaattgataaaagcataataaatatacaattgcaattcggtaaactgaagaacatacatacttcttagacattgctaaaaacaaaatcaaaaaattgtagatcatttttttcctattgttcacaaataagaatggtactatcaatgatcaatctcatttctttcttgaaattatctataaacaaaacaattttcatattggttcatcaagaaacaatactttttatatttctatattatacttacttctatgttacatgtcactatatttgattatcataatttttttttaaagaattggtcacttcacatatatgtatcagatatattggtatcagatatagatgcatgaagcaaattaaagtatcagtactttgtagcaaaacacattcttcaaatcatgacatgaggtaaaaaaaaataagatgatatttttgtaagtattggaaaaaaaaagagtaaagcttctgaaatcaaagagacactaattttccacaacatccttcaattgggcccaagcttcctttcctatggacaaataactggttgttagtgccagccttttctttttaccagttttccattgatggttaaaagctattatgaacctgtcactccttaaaatttccaccaaagtttggtaaataaatatataggagagtgaataatacaagtcttgcattctatctctaagttattaggtatatgaaacaggtatgggtatttggttttagaaggtatgtggttcatcactatttatattattactacaagaaccaggtaaactttattatggtacagtaagtttggtgtgagttgtaactacgttatatccatctcacttagcacgataattaaatttaaaagcaaaaagataagaaaaaggccaatctaacaattgttacctctcttgcatgacaaaatcagaaacaaaagtcccactctttcctccatggtgcctgtaattaacaagcacttcaaaaaccaatgttaattaattaatttccataaaaaaaaaaaggcaaaagccaatgaaatttaaggggtacaacaaagatttgtagaacgatcattaatattagtgcaacgcaccatgatgaagtgcatgacataataataatgtggaaccaatcatgataagaacagaaaataaatcaatgcaattgcatgatcagaaaataacgaggcgatatatcatgttcctattgatcagacaataggacaacgtgttaaagaaatgtgtcaagtgcaacaatgagggaacggagaagagaaggatgataaagaatgtggttatgacttctacaaagtccaattatttacttttttaattttttatattttccttttcactttcctaatagttgtcggattaaaaggagtttatggagtagattagattggttttgaaaaagagaaatatcatctgatacaatttttagttttcttaatttattgttcaattgatgtag

SEQ ID NO: 165 - DNA, 1718 bp, Glycine max
acttctctctgcaagctaaaaaggagtgttgtttaggaaacaattttgaggcaggtgtattttgaaaaaaattgaggagagagcaagtgtagtggagtaaaaaaatcctataagattttgtttgatactaaaaagaaaaaaataattgtgatgagaaaaaataagttagaggataaatatcttcaacacttaaacaaacaaataaaaaagtttttctagaaagttcacttaaatctattttcactattgataaaaatttatacctgttgatttaaaataaaattatattttataaaaattatatttattaaatatgataggagaaaaatattttttacatatagtaaaatattttcatttgctggacttaaattttctttatctctcattttagtattgttgtttgagatgatctcactaaatatattttacttgactaataataaaaattttatatagataagattcaaaggataatcaccaaccaaaaatttttatggaagtatttatcaaataattacaatagatatataacataaaaaaagagttgaattgaataataatttttcatgccaaattactttaatcactctatattattattattattatcattattataacatcttcacaatattctttattttattagtatctattatttattttattaattttatttaataaaaaatcacaaacttttctttttgcacacatctttaacgtacatataaagatattcaaatcttgaattcattaatattatgtttttagggatcaattagcatgtgtcctttctttaattctttctcttttaatttgttcaacattttttttgtcttaataattttttaatctcatttttttattttcctcctaacaaaatttattctatatataagaattaataaaaatttaaatcttttaccacttgattaaaaaacataaatcattatcaattattttaaatttataaaatcatgattcagtattagatctttataaaataccatatctctatgacaattttaatgattaggttgaaatataaactaacacgaatttaagtaaatatttcactatttactttcacattgaaaaattgattttaaattttaactttagaaaaaaaattctaagttgaggatctttacataacttttggatttaacaaaaaaattcattttcaattttactattaacttattttttaaataaaaatatccaaaacacatgtgcaaactgcttcaatacaacttgtctcacagcatcaaagcacaggaacataattatgcacagtacccttgcagccatccacacatatcaccaagaaaaaaacacacaccactgctccacacggtttggaaagcgagaaagctggccatcactaactttaattatagcattttagaaatataatccatttttttaaaattaacggtagaaatatcatcactctttaaatctcttgagtctttagtttagaggagctaaatttaaaatagaaatatcaagaaagcaacatgtggggatcaaaagtaaagagactcccaacgtgataagtcacccaccaccaattcccttgccttttgtcttgcacagcagaacgagtgaaggtgaagagagttgacttaagccaaatctcatcacatcagttcatagcaaccaattcccttgcctttgtctttctactctgatcatcttttgttcttgagata

SEQ ID NO: 166 - DNA, 2191 bp, Glycine max
ccaccaaggaggaccaacaggtatcttctaagtctaaccaactagaaaactatttctgtcaaggatatgtttcatttcatgtctttctacttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgacaaatacttaaatataatgattctccggaaaaatgttacacatcagtgttgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgatgtcaaattgacactttctcaatagctgaatttttatttgtgaggtttttcgttgggtacaatgtgaaggatgaaaaggtgtaccaagtgaactttagaaggattggatgatttcagcttatctcttattccctgtcctataaattaataatggtatgattattctaaaaatatgatagatatgtagataagtaagaattgataaaagcataataaatatacaattgcaattcggtaaactgaagaacatacatacttcttagacattgctaaaaacaaaatcaaaaaattgtagatcatttttttcctattgttcacaaataagaatggtactatcaatgatcaatctcatttctttcttgaaattatctataaacaaaacaattttcatattggttcatcaagaaacaatactttttatatttctatattatacttacttctatgttacatgtcactatatttgattatcataatttttttttaaagaattggtcacttcacatatatgtatcagatatattggtatcagatatagatgcatgaagcaaattaaagtatcagtactttgtagcaaaacacattcttcaaatcatgacatgaggtaaaaaaaaataagatgatatttttgtaagtattggaaaaaaaaagagtaaagcttctgaaatcaaagagacactaattttccacaacatccttcaattgggcccaagcttcctttcctatggacaaataactggttgttagtgccagccttttctttttaccagttttccattgatggttaaaagctattatgaacctgtcactccttaaaatttccaccaaagtttggtaaataaatatataggagagtgaataatacaagtcttgcattctatctctaagttattaggtatatgaaacaggtatgggtatttggttttagaaggtatgtggttcatcactatttatattattactacaagaaccaggtaaactttattatggtacagtaagtttggtgtgagttgtaactacgttatatccatctcacttagcacgataattaaatttaaaagcaaaaagataagaaaaaggccaatctaacaattgttacctctcttgcatgacaaaatcagaaacaaaagtcccactctttcctccatggtgcctgtaattaacaagcacttcaaaaaccaatgttaattaattaatttccataaaaaaaaaaaggcaaaagccaatgaaatttaaggggtacaacaaagatttgtagaacgatcattaatattagtgcaacgcaccatgatgaagtgcatgacataataataatgtggaaccaatcatgataagaacagaaaataaatcaatgcaattgcatgatcagaaaataacgaggcgatatatcatgttcctattgatcagacaataggacaacgtgttaaagaaatgtgtcaagtgcaacaatgagggaacggagaagagaaggatgataaagaatgtggttatgacttctacaaagtccaattatttacttttttaattttttatattttccttttcactttcctaatagttgtcggattaaaaggagtttatggagtagattagattggttttgaaaaagagaaatatcatctgatacaatttttagttttcttaatttattgttcaattgatgtagtttaaaaagttgcactaactgaagtggaaaaggaacataggttggcat

SEQ ID NO: 167 - DNA, 1246 bp, Glycine max
acttctctctgcaagctaaaaaggagtgttgtttaggaaacaattttgaggcaggtgtattttggaaaaaatgaggagagagcaagtgtagtggagtaaaaaaatcctgtaaggttttgtttggtagtaaaaagaaaaaaataattgtaatgagaaaaaataagttagaggataaatatcttcaacacttaaacaaacaaataaaaaagtttttctaggaagttcacttaaatctattttaactattgataaaaatttatacctgttgatttaaaataaaattatatttattaaatatgataggagaaaaaatattttttacatatagtaaaatattttcatttgctgaacttaaattttctttatctctcattttactattgttgtttgagatgatctcactgaatatattaataataaaatttttatataaataagattcaaaggataatcaccaaccaagaaattttatggaagtatttatcaaataattacaatagatatataacataaaaaaaagagttgaattgaataataatttttcatgccatcatttcaaaagaattactttaatcactctctttatattattattattattattataacatcttcacaatattttttattttattagtatttattgattttatttaataaaaaatcacacacttttctttttgcacacatctttaatctacatataaggatattcaaatcttgacttcattaatatatattattgtttttagggatcaattagcatgtgtcttttctttaattctttctcttttaatttgttcaacatttttattgtgttaataattttttaatctcatttttttattttcctcctaacaaaatttattctatatataagaattaataaagatttaaatcttttaccacttgattaaaaaacataaattactatcaattattttaactttttataaaatcatgattcagatctttatacaataacatatctcatcatgtgttagttgtttatatcatcactctttaaatctcttgagtctttagtttagaggagctaaattcaaaatagaaatatcaagaaagtaacatatgtgaggatcaaaagtaaagagactcccaacgtgataagtcacccaccaccataataatacaaataataaaaataaaaaagaccatacttttgtcttgcacagcagaacgagtgaaggtgaagagagttgacttaagccaaatctcatcacatcag

SEQ ID NO: 168 - DNA, 2199 bp, Glycine max
ccaccaaggaggaccaacaggtatcttctaagtctaaccaactagaaaactagttctgtcaaggatatgtttcatttcatgtctttctccttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgataaatacttaaatataatgattctccggaaaaatgttacacatcagtattgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgacgtcaaattgacactttctcaatagctaaatttttatttgtgaggttttttgttaggtacaatgtgaaggatgaaaaggtgtaccaagtgaactttagaaggattggatgatttcagcttatctcttatctcctgtcctataaattaatagtggtatgattattctaaaaatatgatagatatgtagatacgtaagaattgataaaagcataataaatatacaattgcaattcggtaaattgaagaacatacatacttcttagacattgctaaaaacaaaatcaaaaaattgtagatcattttttcctattgttcacaaataagaatggtactatcaatgatcaatctcatttctttcttgaaattatctataaacaaaacaattttcatatttggttcatcaagaaacaatactttttatatttctatattatatttacttctatgttacatgtcactatatttgattatcataatttttttttaaaagaattggtcactttacatatatgtaccagtgaaatatatcaatatattggtatcggatatagatgcatgaagcaaattaaagtatcagtactttgtagcaaaacacattcttcaaatcatgacatgaggtaaaaaaatatgatgatatttttgtaagtattggaaaaaaaaaaaaaagtaaagcttctgaaatcaaagagacactaattttccacaacatccttcaattgggcccaagcttcctttcctattgacaaataactggttgttagtgccagctttttcttttttctagttttccattgatggttaaaagctaatatgaacctgtcactccttaaaatttccaccaaagtttggtaaataaatatataggagagtgaataatgcaagccttgcattctatctctaagttactaggtatatgaaacaggtatgggtatggttttagaaggtatgtggttcatcactatttatatttttactacaagaaccaggtaaactttattatggtacagtaaatttagtgtgaggttgtaactacgttatatccatctaacttagcacgataattaaatttaaaagcaaaaagataagaaaaaggccaatctaacaattgttacctctcttgcatgaaaaaatcagaaacaaaagccccactctttcctccatggtgcctgtaattaacaagcacttcaaaaatcaatgttaattaattaatttccataagaaaaaaaagacagaagctaatgaaatttaaggggtacaacaaagatttgtagaacgatcattaatattagtgcaacacatcatgatgaagtgcatgacataataataatgtgaaaccaatcatgataagaacagaaaataaatcagtgcaattacatgattagaaaataaagaggcgatatatcatattcctattgatcagacaatatgacaacgtgttaaacaaatgtgtcaggtgcaataatgaggggatagagaagagaaggatgataaagaatgtggttatgacttctacaaagtcgaattatttacttttttaattttttatattttccttttcacttttctaatagttggccgattaagaggagtttatagagtagattaaattggttttgaaaaagagaaatatcatcttatacaatttttggttttcttaattcattgttcaattgatgtagtttaaaatttaaatatgatttaataagtttggattgatctcga

SEQ ID NO: 169 - protein, 1229 aa, Glycine max; identical to SEQ ID NO: 2

SEQ ID NO: 170 - protein, 1229 aa, Glycine max; identical to SEQ ID NO: 2

SEQ ID NO: 171 - protein, 1229 aa, Glycine max
MAAALVGGAFLSAFLDVLFDRLASPDFVDLILGKKLSKKLLRKLETTLRVVGAVLDDAEKKQITNTNVKHWLNALKDAVYEADDLLDHVFTKAATQNKVRNLFSRFSDRKIVSKLEDIVVTLESHLKLKESLDLKESAVENLSWKAPSTSLEDGSHIYGREKDREAIIKLLSEDNSDGSEVSVVPIVGMGGVGKTTLAQLVYNDENLKEKFDFDFKAWVCVSQEFDVLKVTKTIIQAVTGNPCKLNDLNLLHLELMDKLKDKKFLIVLDDVWTEDYVDWSLLKKPFQCGIIRRSKILLTTRSEKTASVVQTVQTYHLNQLSNEDCWSVFANHACLSLESNENTTLEKIGKEIVKKCDGLPLAAQSLGGMLRRKHDIGDWYNILNSDIWELSESECKVIPALRLSYHYLPPHLKRCFVYCSLYPQDYEFDKNELILLWMAEDLLKKPRKGRTLEEVGHEYFDDLVSRSFFQRSSTNRSSWPYGECFVMHDRNLENVSQSDEASEARMMDKKHINSLWLEWSRCNNNSTNFQLEIDVLCKLQPHFNIESLRIKGYKGTRFPLMHDLAKSLGGDFYFRSEELGKETKINTKTRHLSFTKFNSSVLDNFDVVGRAKFLRTFLSIINFEAAPFNNEEAQCIIVSKLMYLRVLSFCDFQSLDSLPDSIGKLIHLRYLDLSHSSVETLPKSLCNLYNLQTLKLCSCRKLTKLPSDMCNLVNLRHLEIRETPIEEMPRGMSKLNHLQHLDFFVVGKHKENGIKELGGLSNLRGRLKIDWMGNSSYCNMMSLKLRDCDNCSMLPSLGQLPSLKVLKIARLNRLKTIDAGFYKNEDCRSGTPFPSLESLAIHQMPCWEVWSSFDSEAFPVLEILEIRDCPKLEGSLPNHLPALKTLTIRNCELLGSSLPTAPAIQSLEIRKSNKVALHAFPLLVETIKVEGSPMVESMMEAITNIQPTCLRSLTLRDCSSAVSFPGGRLPESLKSLYISDLKKLEFPTQHKHELLETLSIESSCDSLTSLPLVTFPNLRDLEIRNCENMESLLVSFWREGLPAPNLITFQVWGSDKLKSLPDEMSTLLPKLERLLISNCPEIESFPKRGMPPNLRIVWIFNCEKLLSSLAWPSMGMLTHLYVGGRCDGIKSFPKEGLLPPSLTYLYLSGFSNLEMLDCTGLLHLTSLQQLTIDGCPLLENMVGERLPDSLIKLTIKSCPLLKKRCRKKHPQIWPKISHIPGIKVDNRWI

SEQ ID NO: 172 - protein, 1109 aa, Glycine max
MAAALVGGAFLSAFLDVVFDRLASPEFVDLIRGKKLSKKLLQKLETTLRVVGAVLDDAEKKQITNTNVKHWLNDLKHAVYEADDLLDHVFTKAATQNKVRDLFSRFSDRKIVSKLEDIVVTLESHLKLKESLDLKESAVENLSWKAPSTSLEDGSHIYGREKDKEAIIKLLSEDNSDGREVSVVPIVGMGGVGKTTLAQLVYNDENLKQIFDFDFKAWVCVSQEFDVLKVTKTIIEAVTGKACKLNDLNLLHLELMDKLKDKKFLIVLDDVWTEDYVDWRLLKKPFNRGIIRRSKILLTTRSEKTASVVQTVHTYHLNQLSNEDCWSVFANHACLSTESNENTATLEKIGKEIVKKCNGLPLAAESLGGMLRRKHDIGDWNNILNSDIWELSESECKVIPALRLSYHYLPPHLKRCFVYCSLYPQDYEFEKNELILLWMAEDLLKKPRKGRTLEEVGHEYFDDLVSRSFFQRSRTSSWPHRKCFVMHDRKLTKLPSDMRNLVNLRHLGIAYTPIKEMPRGMGKLNHLQHLDFFVVGKHEENGIKELGGLSNLRGQLEIRKLENVSQSDEALEARMMDKKHINSLQLEWSGCNNNSTNFQLEIDVLCKLQPHFNIESLEIKGYEGTRFPLMHDLATSLGGDFYFRSEELGKETKINTKTRHLSFAKFNSSVLDNFDVIGRAKFLRTFLSIINFEAAPFNNEEAQCIIMSKLMYLRVLSFCDFQSLDSLPDSIGKLIHLRYLDLSFSRIETLPKSLCNLYNLQTLKLCSCDWMGNSSYCNMISLKLRDCHNCSMLPSLGQLPSLKDLGIARLNRLKTIDAGFYKNEECRSGTSFPSLESLSIDDMPCWEVWSSFDSEAFPVLNSLEIRDCPKLEGSLPNHLPALTKLVIRNCELLVSSLPTAPAIQSLEICKSNKVALHAFPLLVETIEVEGSPMVESVIEAITNIQPTCLRSLTLRDCSSAVSFPGGRLPESLKSLSIKDLKKLEFPTQHKHELLETLSIESSCDSLTSLPLVTFPNLRYLSIEKCENMEYLLVSGAESFKSLCYLLIYQLQIFGCPKLENMAGESLPFSLIKLTMVECPLLEKRCRMKHPQIWPKVSHIPGIKVGNRWI

SEQ ID NO: 173 - protein, 1109 aa, Glycine max
MAAALVGGAFLSAFLDVVFDRLASPEFVDLIRGKKLSKKLLQKLETTLRVVGAVLDDAEKKQITNTNVKHWLNDLKHAVYEADDLLDHVFTKAATQNKVRDLFSRFSDRKIVSKLEDIVVTLESHLKLKESLDLKESAVENLSWKAPSTSLEDGSHIYGREKDKEAIIKLLSEDNSDGREVSVVPIVGMGGVGKTTLAQLVYNDENLKQIFDFDFKAWVCVSQEFDVLKVTKTIIEAVTGKACKLNDLNLLHLELMDKLKDKKFLIVLDDVWTEDYVDWRLLKKPFNRGIIRRSKILLTTRSEKTASVVQTVHTYHLNQLSNEDCWSVFANHACLSTESNENTATLEKIGKEIVKKCNGLPLAAESLGGMLRRKHDIGDWNNILNSDIWELSESECKVIPALRLSYHYLPPHLKRCFVYCSLYPQDYEFEKNELILLWMAEDLLKKPRKGRTLEEVGHEYFDDLVSRSFFQRSRTSSWPHRKCFVMHDRKLTKLPSDMRNLVNLRHLGIAYTPIKEMPRGMGKLNHLQHLDFFVVGKHEENGIKELGGLSNLRGQLEIRKLENVSQSDEALEARMMDKKHINSLQLEWSGCNNNSTNFQLEIDVLCKLQPHFNIESLEIKGYEGTRFPLMHDLATSLGGDFYFRSEELGKETKINTKTRHLSFAKFNSSVLDNFDVIGRAKFLRTFLSIINFEAAPFNNEEAQCIIMSKLMYLRVLSFCDFQSLDSLPDSIGKLIHLRYLDLSFSRIETLPKSLCNLYNLQTLKLCSCDWMGNSSYCNMISLKLRDCHNCSMLPSLGQLPSLKDLGIARLNRLKTIDAGFYKNEECRSGTSFPSLESLSIDDMPCWEVWSSFDSEAFPVLNSLEIRDCPKLEGSLPNHLPALTKLVIRNCELLVSSLPTAPAIQSLEIDLKKLEFPTQHKHELLETLSIESSCDSLTSLPLVTFPNLRYLSIEKCENMEYLLVSGAESFKSLCYLLIYCKSNKVALHAFPLLVETIEVEGSPMVESVIEAITNIQPTCLRSLTLRDCSSAVSFPGGRLPESLKSLSIKQLQIFGCPKLENMAGESLPFSLIKLTMVECPLLEKRCRMKHPQIWPKVSHIPGIKVGNRWI

SEQ ID NO: 174 - DNA, 38533 bp, Glycine max
atttaggtgacactatagaatactcaagcttgcataattcatcaaggtatcaatatccactcccaaggcaccacaaaagccttgatggaaattcattttgaggcccgagacaagttcaaagcctctcaaaatgctttttatggtaagcaccttagaaatggttgcttctcctgtaaagagtgcgtcaagcgtcatttgcatattgaagcaagtttacttcctctctcccactacccactaagaaattagagaatttgttcctttcaagtgcttgcctcgtgtttttatgagacaattcatcatcataatataatctcaaaataatatctattccttatcaaaaaaggatactaccaagatacttacaaaattaacatttaaatgttgaaaattgtctcatataagataatatatattaataatgattgccaacaaataagtagcatgaagtacattaagaagaaaaaaatcccttctttttattcaattttttttctcgttctagcgactaaatattttatatcaaagcgtcttgaattagacaacattgttttcaaagaaaatgaagtttgggagaatatgttgagtttaattagtggaggtacttcacaaaaattttagaaggaaggtaattgtttagacatttttgttaatgggagcgaggaaatctttggaggtgatgatcccctctcaatttccgaataaataaccgaagaacaattaaaactatagaaaaatatcaagattccttaaggaagaatccataaatattaaatgatcactgaaataaatcaaataaaaaaaagttgaaggacgaaagtgaaaccaagccttacattaaaagataaaaatattacttttaccttcatgaattttatataaatcttatttagtaaataaagtttaatattttgtaaaaaaaaaatcatataaaatggattcaacaataatgtaaaaacaaaaaaatattagatattctttaaataataaggtacttcggtttgtagaacacattctcaagtttaaagagcttcaacccgacctttgaaacaattaacctagggttagctcgatttggtttaagccagacttgatttaactaagaaattcaaaccgaactaattggtttggttccgataagcaaaacaatatagctttaaatagggtttgtctaactaaacctaagtaaaaatttcactgaaaaattcaaacttgcttcttatgatttttaatgaaattcaaataacattctagaaaatatgtagcgtaaacatggcaggagataggtaagtacaggaatatgttgggtcgttcacagcaggaacttgagccactgatacaactattgaggaagagcaaagaggttgtttacaagtgttcaaaaatagggaaatacaattttgtggctaagaattcttaccgtggaaaactaaaattaaagatcttgcagactcaattgagaggtttttcaatattgaaatgccagctcttattgcacgcgatcaacttgagatcttgcttagggttagtgaaatagaatacttcaatgatgaaaagttttccgattcggtgatcgcgccattagctatagctgctgctgttactgttgctatagttattaaatgtcttctgttctaattttttcatgattaattagggatatttggatagtctggataaggttttagtttcaaactttattgtctttattgtatataagcaaccgatttgtcacgcctattatgtttttgcttttttattgtactttcgcatttctattaagctaattaaagatgttatatatatagttaaaaaattctttcatatgtttttaaatgcatgtttatctttagaattttctttacttcttatactctactatttatgataatatatagtaattcaattttattttgtatattgcatgtaggctaccgtattttttttccaacaaaatgatttgtattaaatggtaccaaaattacctaagatccaaaaacatatacaccagtgacagtagaaagaaagatagctagcttcgaacatggaccattacacccaaagtcatggttttaaaatgtagtcagcaaccataattgcagtcataacgctaatgtattttgactctgtaatcacatcacaattataattatgatcacatcagtttgtatttttccataattatccacaatgtaagatttttaggttcgttgcatgcaacgcaatcataattgcaatttaaaatcatgtctaaagccatgcaacattgatgcggcatcactaaccagcccccaccatcgtgcacataaacatcggttgcatttgggatgatcccactcgaagagcagctaccaccgaatcaaattaacttcacatttcattcaaaattgtctcttcatgaaacaagctccaggtgccatatatcattaagtaaaacaataattaaaattagggactctggcttttattaatccacgatcgtgcaaagaataatatattctgcgtaattttctcagcattgaaagagccattaattccttagcatacactcattcctagcattccatacacaccaaaatttctgatgcccacaccgccctccatacatctgcctccttctttgaacttacgaatacagaatcttgccaaaaatgtgattctggtcattgtggcaacaccacatttacatgcagccagcagccaagagtaacattgcctccaaattagtaccaagaattttatgacatgagaagaaacagtgagataccgactcatctacctcaaggcaaaagggacataagcactcatgaggattataaatggtgtttctcctttttagattatccttcgttggtagtcaatcaatcaagcatcactctccaaattaagaaacacgccttaggttgtatataccttagtgtagtagtatgagaaaaaatatccaagttaaatagaaaattatttttataaatatgaacactttttttaaggcaaaatgtaaaaagaaaagttgcaatttctccccaatctctgcaagaggtacatgtgttaccgtattacatacataaaaaaatggtttctcctaagttaactttcagtcctaaaaaatgccactgttaacttctctaacatcaatcacatttgaagtggctccaaacaccagcaagagaagaaagttcatggttttttgccttatataacaaccactgccatgagatatgttttacggctgtcaaaataccccctggttcacactttttgcaactaaaggctatcatataaaatatttctgttggccgaaatcggttacgtttcttttgatcgaccttggtcgaagttattttttgatcaatgtcggttagaaatttttttgttaaccttagtcaatgatgtttgtgatcgatatcaaccgattatatttttttaccaacatcttgtcaggactattttttggtcaacgtcaccttggttttttcggtcaatgcgacaaagcttgttaccaggaacaacttgaggcacttgcggactcgcttgtcaggtttttcatcattgacatgcaagctcagatggcaagagaccagaaggagatcctgcttaaggttaggagaatacttagcgctgttaataaatttccctcccacacagttgatgcatctaaccctgaagaaaatgcaattctagtatggaagcaacaaatacaagtttgtctttgtcctgctattctgatcctctctctatccagatgtatatatgtttgttagtgcatatatatatatatgcatccatgtatatatgtttgcatatacatacatatatgaatgtacgtagatatattcatatatatatatatatatatatatatatatatatatatatatatatatatacgtgctttgtgcatgtaaccatttgcatttaaagagtttgtatcattatctttgaaacatctttttacgctattttcaatcaatacaagaattttagatcattatcttattcgttacttctctttaattatatttgttaagttaaaaaatattaatgctttaagatgaattaagactcctaattgtaaccacatcagccatactttcccgtgataattcatttctggtttggcaacatttcccacctcaactatctgtgtctcttttagtaaattcagtagggattgtaagattatgtgcttagtttgctttgtttttttagttttatgatgtataaaaaattatagatcagttagtagtttggttttaggttttgttctggtctagatcggatcatgttccgatcttctacatctttagcttttacgcactgtgtgcttgaagctaaggggttatcttttggttcagattggaatgtattggattatgttccgatcttctatcacgcatcaagcccataaaagaggcttaggtcaattcactttcaaagttgggccttgccaagcgggatcaaacgaccaccttaagggggattgacgataatccgactatttcggcagaataagggattaactgattgtttatgatatgctggtgatgcatcatgaagggacaactaacataaacttaatagcacgaaacatttgcgggatatgatggaatattttgatgcagcataaagaccccaacttgtaaaaattgtggggggactgaatgtgcttcattttgaggaggctttttccggaacaggtttgttatatttttattgcatgttatttagaattaaaatctattatgtcagttgtgcatatagcttgcgtcaagtgaatcaataaagattgaactcgtttcatattatattgatttgatagttatatttcttaagtgggaaaatattgagattcttagaacatttttgtcaaagaatccattttaggttcttggattattttttgtgagtcccatgatgttatataggatgcaagaacttctatcatttgttattctaatagtagaatccaatttggattattagattttactagcacaagaaaaaataatatttttgaaaaaatagtagttcttttcctagaacccaatctccatcttaaaaaactcttaataagaataatagtagatctagtggatagggttcttgagttcaagaatcccattaaagatgctattgggcctttgacaaactgtccatgttgtgctactcattaacaaacctgtgcttacatttcataggctctggtgaaaaaatagataaaagttatttatatacaaatatttctaaacattattaaatgtattacataaaaactatagaccaataatatcattaaaaatgacgcattttaatatgttaagcaaataagataatttcaatcaatctcgaacagaaaatatatagagagagatatcgagtttaatacttatgtattgatgatgtaaaatgattttacactattataaattattgtttgaattactttaaaataattattttaaaagtcaacaaacttatcacatagtgagttgcaattaggtaatggtttaaatatatttttggtctctgataaatactcattttttgcatttggtccctaataaatttttgctttgtgataggtccctaatatttaaaaagctttgttcgaagttcctgccgttagtcgaaatccattatcttcatatgtgatcgataaccgatcacgtaagattttttatttttttatagaaaaaagtaaaaaaacgacatcattaagtccccgaatcctccaaaccacccccaccagtccccaaccaactcctccactagctccacaccaccgctattgtgtctccaaaaccccccaaacctcccttgaaaccccatggcagcaacacaacaataattctaacccattttctttttttcttctcttgaaccatggctccccatggcaacaacaaatctccttctctaaaaaatcactcatggaccccccttccccaaagaaaaccctcctctttgttttcatcatttccttctcttcacctacgacacacaagtgagtttgagggccaagtgtgagagagagactgggagagaagtgaggtttgagagttgaaggaagttactggtggtagctggcgctggcacgagcagtggcacgactggcaacaccagtggtggccgatggctgggttggtggtgacctttaagaagggagaacaagaagagacaaccatgaaagcaagggtttgcaaaaagagctcgcaactatgaaaggtcgacgacaagttcagacatcgctatcccactcattttttcgtgctctatgcaatggaccgagcggaatcgcattttagggtaaggttttgttgaccttcttctacccatgaaactattttgatgtgttctcttagaaaccttatccatgtgaatttcttgagttgggagttggcttggtttgatttgaaaatgtaaaattgattgcaagatcctaaaaatcgttggtgaggacctcttcaccttggatcttcacgagtgacgaagtcatagtgacaaatccataagaaaggtatagaagaaactataatgggttgtgtgaaaacgtagaggaatgctgaagaatgattttttgatgcccaagggattttgactatagtttcttatcattagtcaaaatccgttatttgctgaagaatgattcttttatgcccaagggattttgactatagtttcttatcattaatcctaatctcagtcagacaaaaatcacacatgacatgtctgtgtggctggttaacgatcgtgtgagcaaataacagattttgactaatgataagtatttcaaacaaaactttttaaatattaggaacctattacaaagcaaaaatttattaaagatcaaatgctatccattccattatgccaacctatgttccttttccacttcagctagtgcaacttgtacggctgattctttctgctgtcatacacaagcatgtcttgtttctgaggcccatttgtcctttctttttctattccccaccccctcttttccctatccttttatataccttcattatggacctatcaagttctaaccaggaaaattccaaaaacatttctaacccaaatctccaaatttacatgatgtcaaataagaaacaaactaataaataagaaaatgtgattaaaaataatatataacactacagagaaaaaaatcagaaaattaattttccatgcatactataaagagattacaaagtaaaaaaatatatattttcatggaagaaatgttcatgtgaacacaataattaccttgactccgtatagtgatattttgttgcatatcattgcagcaactttttcaagagaatgacttgagtatttcccacctctagcttcttcttcaattttatttgcagaactgttggaatttgaatcagtgggaacttgcagcaagcaagcaacagaagcaagggggtgcaattagaaaacaagaccaagagagcaattacaagacccacttacctcaaggattaggtgtgaaacaagcaggtgcatcatatctggaagaatgatgctggtcgggtaggaatagacaaacttaacaatttcctgatattctgtagcacaaaaagacaaattcgattattgagaaatcagtataaataatactatgtaataacaacatcaatcaatggaatatacaattgttccttcccttattcttctcattcttctctccgtggaggccctggtccttgaaaaccagcttctatcttcttccctatcaacaagtatatagcatatataattatgtatgataattttaagaaaataaacaacactaatataaaatatatagaatagtaaaatacaaaaaaaaaaaacaagatcatatctgcatttccagaagtattttatggaatctagattacccaggaagttaaattaaaaacttgaaagaagaaacagagaaaaaagaaaatattttaagataagttgtaacccggaatcaaaataaaagtttataaataattcaagcacatatatatattttggtgtcttgatcttattgatgtattttgcagacattgatatacttttattaccctatagagctagaacaagatcaactaattgaaggtttagtgacattgtcacaaagcaaagaaaatgcctgatttatgaatattcactttgaatctacgtgagtcagaacaatttcgttcaccaaaatatgccattgcagttgaggtggtcggtcgtatgtgaaagagtctgttatgagatgatgatcttttcatgcatttcggtattgtcctttgcattaacacttacacaacattctccaactgagttagcagtttgtcagtagtgaaaccctccttgtccaacaattccatatgaggaacactacctgacaacattgctgatttcaaaagccttgaattcttggatatctcttataaactcttttcctcatccttgccattgggaattggtaaattagggagcttgcagaatctctcgttggctgaaaataacttctcctgactctatttcagagatggcctccatcaagtccctcaacttgacttgcatgggaatatgcttcaaggtgtacccaacagtagtatgttagaaattctgaggaactctatgcattctgcactctactttttcacgaaatgcctccatttcaaaccaaataaaatggtgatcaaatcttcaattctctcattaaaccaaaaaatatatgaacccaacagtagtatgcccttaaaggtgtaccatgcttcaaaaagcttcatcaacacatgcgaaattctgaggaactctatgcattctgcactctactttttcacgaaatgcctccatttcaaaccaaataaaatggtgatcaaatcttcaatactctcactattactttcctatatatcaatattctcactttctaaggtacaaactatcaggacacttccttttttctaacaaacccatgatcacaaatttcttgaaaaatctaataaattcaaaaggttcatgagactgcattcatccaattctaacagtaaataacaggaataaaggcccatggttcagaaatattcaatcagcataagttattacaacaacaaaccttgtatagcttcttcccagaaccaaattaaaacctttactctgaatttgaagaacaactagcaactgcgtatatcagtatagcttttgttccttaactggccctgtgcaatttgaagtttagcttttgttcgcaacaaatcaccttgatcccatatatcgaaaacctcctttcactgaaaacctccttccaacaaaagatccagaagcactgtgtcacacacttgcacagtcgcactccaacaccgaaaacctcctttcaccgtcgcaccccaccgtagcactctagcaccgactgcatcacagcaagaagccaagaagcatgaaccaaacaattttgcactttgcataactcgaacaaggtagacaaagtctactcaaataagtagctacaacacgacaccgtttcgggttttcgtaaatccacatactcgtagcagactcgcgagtctacccaaactcgcccaagtttgcgctaaatcagatgagtctattccgttttcaattctgctttcgatttaactcgctgaagcttagtggaatcgtaaaatcatacaattctacgatttaaaacatgagtttaacaaccttggatgattcaagtaaaataatcctactagagatcttatgtgcaaatgcaacgaaacacacataaaagtacatattaaagatttaacaatatcataaatttaaataattttaaatatgatagagatcacaaatatcattgatgggatacaatcttactcaatgtcattatggacgtcaatgttcctaccctgagtagttaacacaaatgcaaaccaaaaattcaataataattatttttatttttaaattctataaaatcattttaagtaaatatataatagatatattaaaattaatatattagtccccgttgatccttgtgtatgaaataaattgggttgggaggggaatagtcaaattatgtgcactcagaattcttgaggaagattagtcacttagtatttttattttaaaaaaaattaaattatttactaagaaatagcataaattaaattagttttattctctttgggataatgactaaaaataattcttcttatgggccaaccattataggaaaaaaaaaactctttcgcgagtaattaaaacaattgcatattaaagactcaacaatttatttttaattcgaaattttataaaattagttttaattagaaatcatataaaataaaattaaataatcttataaataaatattttattcattaatatttatattataaggttgaaatttttatactataaataaatttaattttaattagttaacaaatttattacaaaataatgttttgactctatgttaaaaattaattaattaaatatatttttattaaaactaattttaaatcatttcgtcaataatctcataaacttaattagtttaaatatttttgtagtagaaatcataaatatcattcataagaaaaaatcctactcgaaattggattattatatgcaacaaaactatttcttccaatattttataaaactacataccaaaagacttaataatatcatatattataataattttagttatgctagagattacaaatatgattagtgacaagaaaatcttgccaaagactattatagaccacaatattttttttatccaagtagttaacacaactacacataaaaaaaactgaaatagtatttttttttttactttcaaatcttataatattatttttatttggaaatcattcttacataattatataacattttattaaatatatttttatcacaatataattttaaattacttactcaataaaatcataaattatattaattttaatttttacataatatgtagtaataaaaatattaaaatcaatttataaaatgtatttttattacaaaatagttttaggttacttactgaatatgctctttcttcaagtatttcacacaaattcatatcaaaaacttaataatatcataaattaaaatcattttaatcatgacagggatcttaataatcattgatgagaaataatcctactcaaaattattacaaatgacacagttctttcgcctagtagttaacacaattgtatatcaaagagtaaaaataatattttttttttaatttgaaaacccatttttactttataatcacttctacataatatataataactactaaaatttaattattaaatataatttttaatacaatacttttaaaatacttactcaataatacatttaattaatatatattttttatgatagagaccaaaaatatcattcatgaaaaacaatcacgtgtttaacgtcattacaggccaattattatgggtgacaaagctttttctttaagaatatttaacataacaacatattaaagaatccacgatatctttttaaaaatttgaaatcctataaaatcaattttacttagaaaccgtataaaataattttatgaatgaaatattttttgaataatttatgttatgtagttgaaatttttatactattaattaatttaaatctaattaggtaatatgtttattacaaaatattattttgtctctttttttaataacttcatatatggaaattttattaactaatatttataaaataagtttaaatatcattttttcataattatataagaaatattttaatattaatttattaaatatatttttataacaaaatattaaatactgaataatatcacaaattaaattaattttaatagtgttgatttttttacataaatacataataaatatattaaaatagaatttatgaagataaaacaggtaaaaatatgaataatagtttcaattttcaaataatagaagacaatgatttaaatagcctaaaaattaggattttgattttttttttgcttgaatattctaatccttttttcatgtttattgaatataaatactaaatagctaattatcttttttaagcaagtgtattttgaatatgcgtaaaaaaggagagcgatctgcgtaaatgtatgggtatcttgctagttattaacttattgtaaatggagatataatattgatgggatggttaaaaaattatgaaagaaaagaaaatttgtgactttacttccttatactaacaaaaactcacaaaataacgattaaaatttatcaattaaaaaaacttattataaattcaactagaaaacaactttaatttcagtgatattcgtaaatggcagacaacatttcatcacttcactttaataaaggatgcaaacttgcagtagtaagggaaaaatcaagcttattaagacataattgaataattgaagtttatttcaaaattagttaatttaattatggtaaatgttaactagtgtttttaaggtattaattggttataaagaactaaaataataatttttttattgaaatatataaaatagtattatttatgattttttttacatactcttatgattttcataataaatatttttttattttaatttattaactaatgccttagggcactgattagcaacatcctttaggttttagcaaccattaattgatttttattttttagccattgaatttttcattttaaaattattataaaatattaatttattaaatcagaaactaaaaagaacaatttatcaaaattcagagattaaaaaaacttttataattttagtaactaaaaaaatctcagcccaacaataaagaaaaataaatataaacaatttaatagtaaatttaataattttttgcggtgatcaaagatatggttaaaatggaagtttgttgttgacttaatacatgccaacaaggtactatgatgggtgacatggcatgtgaaaaattgaactctcacgtccttgttatgtcaatcttaacatcatatcaccagtcttgtgttagcaaaaatttcttaaatatttataagaaaatttatagaagaatgaaaatcacccaattgttttgggatctatgcaagcaaaagtatacaaacaaaacaacatatacagaaaagtacatacacaccattctagagagggtgtgcttatttaattgccaacaaaacaacatattataaattgagcatgcttatttcaagagtaattaaattaactaccaatttgatatctagagtattactctttcttataaatagtccttaaaataacaaaatcatatataagtaatttctaaagtgttaaatatccattaatgcatatatacattgaaatattttatcaatgtataaggattaatttgaagaatgtttcaatacttgaaagaattaatttatattttattttagtgactatttaagagatgaaattgataatttacgctggtcttatttggattcctcgaacttcaatgctgctcttggggttctcatcagtgactattatagaactcacccaatcttacctccatccacccatcgtttctctgcacagaatgtccatgcaagagtggggatgtcacggaacgttaagggacacctcaacaggcttgttcctgaacccggtggcattattccttagcctaaacactaagtatgcctcctataccggaacttgtttctaatgattattttttaaaaaaaataacaaattaacatatttaatatattaagaatacaatgtatttgaaataaattaatttcaattctatggtaccaaaagtaactggatttgaaacatgtttcaattgttaatattttggtacaaggaaaatttccgagatagccaaaactgtcaattgaaaccttgagataccataaatatgacccaacataatcatatatcatatatatactcctaggaaaatattttttacatgaaataaagtctcctcatccttgccatatgaggaacactacctgacaacattgctgatttcaaaagccttgaattcttggatatctcttataaactcttttcctcatccttgccattgggaattggtaaattagggagcttgcagaatctctcgttggctgaaaataacttctcctaactctatttcagaaatggcctccatcaagtccctcaacttgacttgcatgggaatatgcttcaaggcaatttggattaataaattactctagaacctgaaaggttagttaattcacaatttttttttaaaaattattattaccaaaattttatgatatcattgatgtttatatttttatttattatatatatatatatatatatatatatatatatataaaaattattacattacttaaaaattatttatgaaaagtaaatttaattaaatataatattcagtaactattcaagtatatataaatataattatcaacttgtataacagagatatacttttagcttctttttagaaaatattactattagctttaaaatgatttatatatatgtgatattttaaattacattttttggtaaaatattttaaattactttgtatcacagttattatatatctttaatattttttttttgaaaaaatagaattaaaattaaaacttaagatcgagatcaatccaaacttattaaatcatatttaaattttaaactacatcaattgaacaatgaattaagaaaaccaaaaattgtataagatgatatttctctttttcaaaaccaatttaatctactctataaactcctcttaatcggacaactattagaaaagtgaaaaggaaaatataaaaaattaaaaaagtaaataattcgactttgtagaagtcataaccacattctttatcatccttctcttctctatcccctcattattgcacctgacacatttgtttaacacgttgtcatattgtctgatcaataggaatatgatatatcgcctctttattttctaatcatgtaattgcactgatttattttctgttcttatcatgattggtttcacattattattatgtcatgcacttcatcatgatgtgttgcactaatattaatgatcgttctacaaatctttgttgtaccccttaaatttcattagcttctgtcttttttttcttatggaaattaattaattaacattgatttttgaagtgcttgttaattacaggcaccatggaggaaagagtggggcttttgtttctgattttttcatgcaagagaggtaacaattgttagattggcctttttcttatctttttgcttttaaatttaattatcgtgctaagttagatggatataacgtagttacaacctcacactaaatttactgtaccataataaagtttacctggttcttgtagtaaaaatataaatagtgatgaaccacataccttctaaaaccatacccatacctgtttcatatacctagtaacttagagatagaatgcaaggcttgcattattcactctcctatatatttatttaccaaactttggtggaaattttaaggagtgacaggttcatattagcttttaaccatcaatggaaaactagaaaaaagaaaaagctggcactaacaaccagttatttgtcaataggaaaggaagcttgggcccaattgaaggatgttgtggaaaattagtgtctctttgatttcagaagctttacttttttttttttttccaatacttacaaaaatatcatcatatttttttacctcatgtcatgatttgaagaatgtgttttgctacaaagtactgatactttaatttgcttcatgcatctatatccgataccaatatattgatatatttcactggtacatatatgtaaagtgaccaattcttttaaaaaaaaattatgataatcaaatatagtgacatgtaacatagaagtaaatataatatagaaatataaaaagtattgtttcttgatgaaccaaatatgaaaattgttttgtttatagataatttcaagaaagaaatgagattgatcattgatagtaccattcttatttgtgaacaataggaaaaaatgatctacaattttttgattttgtttttagcaatgtctaagaagtatgtatgttcttcaatttaccgaattgcaattgtatatttattatgcttttatcaattcttacgtatctacatatctatcatatttttagaataatcataccactattaatttataggacaggagataagagataagctgaaatcatccaatccttctaaagttcacttggtacaccttttcatccttcacattgtacctaacaaaaaacctcacaaataaaaatttagctattgagaaagtgtcaatttgacgtcaattaaattaaaagttacatttagcactagttcaaatttgaacttagattcatgggtaggtacagtttctccgggccaatcaaccatatctgaaaaacaaaaataagtttcccacggtcattttcactctggcctcaataatcttaaggagaaattaagttagaatataacaatactgatgtgtaacatttttccggagaatcattatatttaagtatttatcaatgttgttacttagtacctgtatcgttacttcttcgaaacatatatacaaggtcaatttccacgttgcctttgatgatttgttgattctctgtagattcagtaacatatatacaaggtcaatttccatttcagaatgaattggatttagtaaaacgtaaaaggagaaagacatgaaatgaaacatatccttgacagaactagttttctagttggttagacttagaagatacctgttggtcctccttggtggctaaatccatctattgtcaaccttaatgccagggatgtgggaaattttaggccaaatttgagggtgcttcttccggcatcgttttttcagcaaaggacaactctttatggttaattttattagagagtcaggaagcctttctcccaccatattttccagcaaaggacatccgtctatggttaattgttgcagggatgtgagatggagaagccccgtgcagtccaacatctccagatttgagaatccacttagatacagatacgtaagggagggaggcagcaaaccctccttagggaaggacttgatgccatcacatcgacccccaacatagagatgagtaagcatgcccatggatggccatgctaggctgctcagtagtttctcacaattgaaaatccaaactattctcaggttaggtggcataccccgttttggaaacgactcaatttctgggcagttggatatgaggagacgttctaactttgggagaagagtactcatctcatcaggcaacgacttcaacttgtcagagccccacacttggaaagtaatcaagttgggcgcaggcaatccttctctccagaatgataccaaaagagattccatattttcacagtttctgatttcaagatctctgagatttggaaaggtaaccaatggaagagatgtgagtgaatcacaactgctttctattgacagtgtttccagtaactcatgtttgtgttgcgtcgggaattccagttttttaagatccgagatatacagactcttcagtgattcaggtaaacgaccacccggaaatgacacggctgacgagcaatcccttaatgttaaagaccggagacaagttggttggatgtttgtgatggcctccatcatggactccaccattgggcttccttctacttttatagtttctaccaagagaggaaacgcatgcagtgctactttattgcttttacgtatctccaaactttgaatggcgggagccgttgggagagaagagccaagcagctcacaatttctaattgtaagtgttttcagagcaggaaggtgattcggcaaacttccctctagtttggggcagtcacgtatttcaagaatttcaagcacaggaaaagcttctgaatcgaaggaactccacacctcccaacaaggcatttgatgaatggccagagattcaagggagggaaagggcgtcccagaacgacaatcttcgttcttgtaaaaacctgcatcaatagtcttcagcctattcaatcgtgcaatcttaaggaccttgagagaaggtagttgtccaagtgaaggaagcatactacagttgtcacaatcacgcaattttagactcatcatattgcagtaggaagaatttcccatccaatctggaaatctggttcctttatagccttttattctcaacgattcaatgttaaagtgaggctgtaacttgcaaagcacatctatttctagttggaagttggtactgttgttattacatctagaccattccaaccataaactattaatgtgttttttatccatcatccttgcctccgacgcttcatcactttgggaaacattctccaagttcctaattttaagtcgaccacgaagatttgaaagtcctcccaattctttgatcccattctctttgtgcttgcccacaacaaagaaatccagatgttgtagatgatttaatttactcattcctctcggcatctcttctataggagtttcacgtatctcaagatgacgcaagttaacaagattgcacatgtcactaggcaacttagtcagctttctgcaactacacaacttcaaagtttgcagattgtataaattacacaatgactttggcagtgtttctacacttgaatgagaaagatctaaatagcgcagatggatcaatttacctattgaatcaggcaaagaatccaaactttggaagtcacaaaatgataaaactctcaagtacataagcttcgacacaatgatacattgtgcctcctcgttgttgaatggagcagcttcaaaattgataatggacaagaaagttctcagaaattttgctctaccaacaacatcaaagttgtccaagactgaagaattgaatttggtaaatgacaaatgacgagtcttagtattgatctttgtttctttcccaagttcttctgatctaaaataaaaatctccaccgagtgatttggctagatcatgcatgaggtcatgcatcacaaaacattcaccataaggccaactacttctatttgtacttgaacgttggaaaaatgatctcgaaaccaaatcatcaaaatactcatgaccaacctcttctaaagtcctacctttccttggtttcttcaaaagatcttcagccatccacaacaagattaattcatttttatcaaattcgtaatcttggggatacaacgaacaataaacaaagcaccgttttaaatgtggagggagataatgataactaagtctcagtgctggaataactttacactcactttcagaaagttcccaaatgtcactattcagaatattataccaatccccaatgtcatgctttcttctcaacatgcctccaagggactgtgctgctaaaggcagtccatcgcactttttaacaatctcctttccaattttttctagtgttgtgttctcgttcgattccaaggaaagacacgcatggttcgcaaacactgaccaacaatcttcattcgacaattggtttagatgataggtttgaaccgtttggactacggaggctgtcttttcactgcgggttgttagaagaattttacttctcctaataatcccacattgaaatggtttcttaagaagactccaatcaacataatcctctgtccaaacatcatccaaaacaattaggaattttttatctttcagcttgtccatcaattcaagatgaagtagattcagatcattcaatttacaaggatttccagtaaccgcctgtattatagtttttgtgaccttcagaacatcaaattcttgagaaacacaaacccatgccttaaaatcaaaatcaaatttctctttcaaattctcatcattgtacaccaattgggccaaagtagtttttccaaccccacccatgcccacaataggaaccacagacacttcactaccgtcactgttatcctccgacaacaacttgattatggcctccctatctttctccctaccatatatatgagatccatcttccagagatgttgatggagctttccatgacaagttctccactgcactctctttcaaatcaagactctccttgagttttaaatgagactctagggtgacaactatgtcctccaacttactaacgatcttccgatcggaaaagcgagaaaacaagtttcttaccttgttttgggtggcagctttggtgaaaacatggtcgagtaagtcatcggcttcatagacagcatctttgagagcattgagccagtgtttgacattggtgtttgtgatctgtttcttctcggcatcatcaagcacagctccaaccactctgagagtggtctccaactttcgaagcaacttcttgctaagcttctttccaaggatcaagtcaacaaagtcaggtgaagccagcctgtcgaaaagcacatcaaggaaagcagagagaaaggcaccaccgaccagtgctgcagccattatctcaagaacaaaagatgatcagagtagaaagacaaaggcaagggaattggttgctatgaactgatgtgatgagatttggcttaagtcaactctcttcaccttcactcgttctgctgtgcaagacaaaagtatggtcttttttatttttattatttgtattattatggtggtgggtgacttatcacgttgggagtctctttacttttgatcctcacatatgttactttcttgatatttctattttgaatttagctcctctaaactaaagactcaagagatttaaagagtgatgatataaacaactaacacatgatgagatatgttattgtataaagatctgaatcatgattttataaaaagttaaaataattgatagtaatttatgttttttaatcaagtggtaaaagatttaaatctttattaattcttatatatagaataaattttgttaggaggaaaataaaaaaatgagattaaaaaattattaacacaataaaaatgttgaacaaattaaaagagaaagaattaaagaaaagacacatgctaattgatccctaaaaacaataatatatattaatgaagtcaagatttgaatatccttatatgtagattaaagatgtgtgcaaaaagaaaagtgtgtgattttttattaaataaaatcaataaatactaataaaataaaaaatattgtgaagatgttataataataataataataatataaagagagtgattaaagtaattcttttgaaatgatggcatgaaaaattattattcaattcaactcttttttttatgttatatatctattgtaattatttgataaatacttccataaaatttcttggttggtgattatcctttgaatcttatttatataaaaattttattattaatatattcagtgagatcatctcaaacaacaatagtaaaatgagagataaagaaaatttaagttcagcaaatgaaaatattttactatatgtaaaaaatattttttctcctatcatatttaataaatataattttattttaaatcaacaggtataaatttttatcaatagttaaaatagatttaagtgaacttcctagaaaaacttttttatttgtttgtttaagtgttgaagatatttatcctctaacttattttttctcattacaattatttttttctttttactaccaaacaaaaccttacaggatttttttactccactacacttgctctctcctcattttttccaaaatacacctgcctcaaaattgtttcctaaacaacactcctttttagcttgcagagagaagtcggggttagggaacccaacttctctttgctcctattattttttaatttaaaaaaaattattaaattctttttttatatttttttaaaaataatttacttgttttttaaatattattttcagataaaaaaataactaaattttttattattattattttgttttttaaataatgagaatattttttgtttaattatttatttatagtttgaaaataattaattaataatcttaaaataaatttaaaaaacaaagtgattaaaaaaatagattgattaaaaacccaataaatatatgattatcacatcttaattatattatattaagaaattaaaatactcaaataacataaaatattaaaaattaaagagacaaacatcataaatggaacatataataaagcaaaaataacagaatggactaacaataataattgaaacatgaaaataatgaaagcataaacaactaacacatgaatcattcccattatcaacctcatttgattattaatccttgggaaggagacatgttacaacctaccatagtttttttacctaacaactatggtattcattctagaaaaaaaaatgtgaaaattttcgataataaaaacataacagaaaaaattatttcaatatatcttcatcttcagttttttcttagataaatattattgttcatgtattttatttatgatgtaatgtattccagtataaataaattgttaaaaatatatatataattagtttttatacatttttaaaaaaatactataaacaaaaaattcatttattaatttaacttgttaaataaaaatttattttttaaaaaaagaaaaattaattcctttatttttttaaatattatttttacattaaaaataaattaattttttaatattactgttttactaaatatattttaatataaaaataatatttaaaaaaataaaggaattaatttttctttaaaaaataaaaaaaagttaaatattattattatggtggtgcgtgacttatcaggttggcctagatgctaatatagtaaagaatattgtgaaaaagttgtaataagaagaagaagaagaaggcggatacaagctagatcttacataatggtaattaggaaaaacaaaaccagagaccccctctgatagggaagagtgatagcatagcatacaaagggatgtattcagaaaaaatagatgtgaatcaagacatagcaactacaggggtgtctatagcaaagaagggtgtaaatcaagtagaaaaggaggtgcaagcagcagttaataccaaaagaaagatctcgaagcctgcttaccttaaggactacgtgtgatcctaaggaatgatgctgaatgatctgtgctagaagcaagggagacaagaataacgatttctgatttcctctagcacaaaaggacaaaatctgttatgtagaaatcagtataaatacaatagcatgtaataagcagcacgatatgaatgaaattagcaaattactctcatctctgctcttcttcttcctctggaggttctggtgcctcgaagccagctcttaatttcctgcatttatgttcagttcgtaacaattggtgctctcgtttgtcctcatggcctcacgcaacctcgacaaggcccttgttcgtcttgacaataccatgcactctatgaccctcaatatggacaagcttcgcaaccgccttgctcctgtgccttcctccaccacgcccaaccccacaccagtcccttgccactccacctctgttcctgcacaaatccgatatgcctcatcaccgtatgaggatcctgtcgatgccttgttcaaactcactcagacgggttcagtgctaacatacctgaaggagttcgaagacttggctaatagaattatcggcttgtcggcccccttcctgttgccttgcttcatctcgggtttgacgtcggagatccgccgcacagtccaggtccaccagcctatgactgtggaccaggccgccagccttgcgaagatccaggagcagaagctatcggaccttcgtctgcctccaccgcggccgcgaccccaccgttggtagctccaccaccagcccctttggttccccctcgtatcacgcctttgccccctttgctgccttccccgccataggctccgaccgtcaggcgtctcaccccggaggagttagcctcgcgccataagcacgggctatgcttcacattcgatgagaagttccatagaggccattgatgtgcctctagggttcatctcttaatcgcaaaggatcaggaacctgtagactaggggtgggtaaatgggcccaggtccatggactggcccgtggcgcccgcgatccgctcgagttacgaaccaattttttaaaacagttcatggttatgtcatattttttggtccgccccgcttaacccgcggactatgcgggtttggccgcggggtccacgggttgcccgcaacccgcatttggtttgatttgtgtgaccctgacccaattatattaggtttgattttctctttttcactttaaacttttcttttaaaataacaaatgaagaaatatattatataagataaagatttaaaggtaaaaataaaagatttaaaggtaaaaataaaagatttaaattaaaagatggtaaagataaaaaagataagataagaaaaataaaagataacagaaataaaagattaagataaaaaaatataagtgataacatgctaaaaatcttcctttttgatattttctcgatctttttttcttttaatctatcattttcatatttgcaagtcataaataataaaaatatcaattcttatcatttaagctaaaaataattgttaaataaatatttttaaagatatttcaatatatttttattataaaaaatagttcacatcatatttaacactctttcccttacaaggaaaacaaaacgcgactcatattcacgcagtcacgcgacacaccacagcgacacagcttcggcccaccaccgtgccaccacgcaaagtacatctcttctctctctagaatttgtttttatcctatttttgttgggactgattcatttttgttgtactcttaaatgtggagatggagaatgttcaagctacttcaaatatggaatcatttattgttagagatgtttaaatttcatattttagatttattgtttggattttcttttgttaagacattatttattttattgatgtaattgactaattattgagattttatttacatctatattaatttaattatgttgcacacattgacatggtgtttttgaaaagtcaatccaataaactataccagttttagtccaaatgaaatgcaattacttaaaaatgattgcacaaatgtttgaacctagtatcacctgcaaactacccaaagaccttgtcactagcccactaccagtggcacgtccaatatgatgagcttcaataaacattaaaacatcatgttaaaatacaataaaggagataaaatggcaaggtgtcagccttcaagcataaatcaatctgcattctgcaagcaaacatcaaatctccttatttgtgcctttctttttaagtcatgcaatattatgtatcgtttactgctaagcaagatgaaagagcaatcataacatcatgggtcagtacaaacaaatatactgcaaaccgaaatgcaaccttgtttacagcccaatgcttcttttcaattaatttcattccaacatagcatgtaaattgaacaaattaaaaaaattactatccataacatctatttcgatgaactatcgcatagctaatctatttgttcggggtcttgaagttaaagcttggaggacaaaacaaagtagtgtacaagtacttggtgctatggcataccgtgctcctcaacatttgtctcggtgtctccttaagattgttcccaaattgactgagatataatatgaagcaaacattatttttcacttctaaattccttttaagctatagattgcattaccttaacccatctcggtatttgaaggttttgactgatacacatcctatagtcagtcagctgggcaaatggccccttcaacacgttagtcttgacttacaaactattctatccatttgattcctgcttctgtgattaatgttttttatttcatgtttttttcaggttgggaatgtgataaaaagttcagaaatatctggtcttgtccttactctacttaagtaaattggtgttttcggtatctagagggaggaataaaagtaattcttttaaaattgtggcataaaaaatcatcatttaattcaactctacttttatatgttacatatttattgtaattgtttgatttatatttttatgaaatttcatccttcaaatcttatctatacaaaaatattactgttagttaagtaaaaaaaaataatgagattatctcaaacaacaatagtaaaatgagagagaaagaaaatttaagtcaacaaagaaatgatgagcaaatgaaaatattttattatatttaaaaaaagatatatttttctcttatgatatttaataaatataatttctataaaatatttttttttattttaaatcaacaattattatgaaatataagtttttatcaattgttgagataaatttaagtgaacttggtatcaatgattattgtgtagttaaagtcctagatccaactactcataaaaatttaaattttctttacatgtaatataaatagacataactctaaaaatgaaaactttttttattagtttgttaaagttttataaatatttatcctctaatttattttttctcctcacaattatttttatctgctgtaaaagataaattataatgtattttctaacaattttaatatactattattatatttttatttaatatttaagaatatttctataatttaaactcatgcactaagtataaattatatttgtttccatgacattaatacaaagtatttattaattttatatactgataactcatcttcatagagaaatttagttattcatctttaacgaagtcactattttcaattatttttaatatgtaagacttaaatctaaaatcttggctcaaggggatttgtcttaacttttcagttcatcatgggaaatgatgctaaagtcacaagctaagtaaagtcttaccaataattatttctgttaagccgaactcaggtaatattcaaacgattcaactttattttaaatacactaaccacttgtactcagtcacttagtcacttggttgcaacagatttagtttcactctaagcaataacatgttggtcacaagaatatatattacatattaactttgaaaataaaatataataaaatttctaactcaactttttaattttcttattttcattctaatagtatggtcactcattgtaatggcccgcctcttcgttacgatatcaccactctaaactgcgaaaaatttcaatttttaaatgaaaaactccattaatttgcttatgaaaaattaaagtaattttaatttcacgatatacattccgaaacaacgcatcattacttaaatgaatacatacatatatataggcatagtaacttagtacacatcattcacacaatggaaggtaaatttgttcatacatataattaagtttgtgatttacatccttaattcaacaaaaaaattatggaaccaactatgaaggagttgattaacaaaacacaactctctctcaaaataatctcaacgtcatcacgtcagttcggcgacttcacatcagaatctcactttctgcaccttactgctgtcattctgctcccacgaacaaggttcgcgatcatcacaagtatcaaccacacgatacaaaattgcaagggtgagttcattataaaaagaactaatactaaattcaaataaccacaattagcaagaaaacattaacaaatatcatgagcttatacaacattcattaatcaacacacactcaacaaatagtcatcattcatacatagttccaattaatcatgttcagtatgatgcatgcacctgatctcaactcttagatgcaatgtggtaccatccccaaggaaatagcataagcgtgtccacacgacactctcacttagaaaaacaagacaataagtgtcgaggtcatcctgtcgtacacatgcaactctttaaccactctattttcccccaccaaggacatccgacaaagtcaatgcacccccatgaacatacacaacatacaacgtataaaatgtgggcaccatcaagtacactgaccatgaatgaattaaagatcctaagtcatcccctcagagatgcttaaactctttaaccactttattttcccctaccagggacatccgacaaggtcaatgcaccccatcacgaacatacacaacatgcttcatctcaacgcatttccaacatcatcaacatctcatttcaatatcactctcaacatcaacatctcatcatctcaatgacattatcaacaacaaccacatcatttcatattaacataatcatcaataataacatcaattcatgttgacatgatcatcattaacaacgtcatctcaaatcaatatcatcataaatgtcaacatcaccacatatcaattaaattcatcaataacaacatcaacaataagtcgcattatgcatatacatatatctttcatgtctgagattcacattctctaggatttcaaacaacacaagtctaatcaagacaataatgatattcatcaataatagatatatcgcatctcactcgtcaaaaacattgttttctaaaaaaaaaaatcaacatatagcagggacaagcatatatatatatatatatatatatatatatatatattacattgcttaaaattatttatgaaaagtaaatttaattaattataatattcagtaactattcaagtatatataaatataattatcaacttatataacagagatatacttttagctttttttatagaaatattactattagctttaaaatgatttatatatatgtgatattttaaattacattttttggagaaatattttaaattactttgtatcacaattattatatatcttaaatatttattttttaaaaaaatagaaataaaattaaaacttaaaattgagatcaatctagactgattaaatcatatttaaattttaaactacatcaattgaacaatgaattaaaaaaaccaaaaattgtataagatgatatttctctttttcaaaatcaatctaatctactccataaattcctcttaatcggacaactattaggaaagtaaaaaggaaaatataaaaaattaaaaaagtaaataattcgattttgtaaaagtcataaccacattctttattatccttctcttttttgttccctcattgttgcacctggcacatttctttaacatgttgccttattttctgatcaatatgaacatgatatatcttctctttattctgatcatgcaattacactaatttattttctgttcttatcacaattggctccacattattattatgtcatgcacttcatcatggtatgttgcactaatattaatgatggttctacaaatctttgctgtaccccttaaatttcattggcttctgccttttttttttcctggtagaaattaattaattaacattggttttgttaattttcttaagctcatcaaaatattcatagaaattttataatatttcctacataatctcgtaaaaaaattgttttgcataaattaacttaatttgtattgtgtttttcccgattcaatagcatatgagagtacaaagccgtattaaaaaaaaactaaacagtgttattagtaaagtggaaaatatgtatttaaatattataaaataattaattaagaaaatagttaacgaatgaatagtataattaattgcttaaagtcacctataaaaatgatattattaatattattgtatttaacttatatattataattttagttatttaggcttaggtatacctataataaaaaaatgttataggtatagtggtttaataaacactattaatgtgtgacatgggattgaatcaaactataacattttatgaatgttttcatcattttagtctacatcactttaaaaaactaaaattctatcattatgcaatacaaaaaaactaaaatgacatgattataaaactcccaaggactaaaatcaaacaagtcaaattaaaaatcaaataagatgccaaattaatcactatctcagtttaatgccaataccatatcaatcaatgccgccaactatcaaaaggattaaaatctcacacttataatattcaggagactcaattaattagagaataaaattatattataatgatacatgagaaaataagtataattaagtcaaatttttacacataaaaacttaataaaaatcatatgtctcctggtagaaaaagtcttactcaaaattttatctagtgttgattttttttaatgtatcagcgttgaatttaagaagtatgtacattttttttatttagtatcaccatatgcaattaggatcttaggttcccaataatattctaatgtatgttcataaactttgattatttgaattaattataagattaattttcaattagaagtgagacttaattatacttaaaaattattatttttttcaaaaagaatgtattttacaaaaatcaaactcaaattctaatccataaacttaacttatattatcaaatgacttatgttgattaattctatctccatattatgctttaaggtcacaaataacacaatcatgcgagaaagaaaaataaataaatttattgacgatcaatagaaattaaatagtatcaacaagataaatatgttaagaaaatagaaatataatttttattaatatgaaactgtgaataaatatatcatcttctataacattatttcatggttattgataataaaatattaaaactgaatcacaactaaaaaaataatatatatatatatatatatatatatatatatatatatatatataaagatttagaattaaatttaaatcatatttaatgtctatcattaatgaattataacaaaataaaatgtcttttgattatcataatcattataaggatgttgaagataacactttcggccatcgccaatttgaacaaagatcaaccgataaaatccgcgagatatttttggttgcgtattacataatccatacgtaatgttaggtcatgcgcaaatagtaaactgtattcgaatactatctctgtgtatttttaaatttatcttaagttaaaaaatttatgttaacttaaaataagatacaacaaaaattaacatactagtttgcaaatttattttgataaataaatatatcataagataatgtacaaatatttaaacataaaaatatttaaataataaaagatagatttaaatgtattttatattttaaatccaggcacagcaatcacgcgtgcgattggcactaactcagatggagatggctctgtcattgtcttttacctgtcgactcgacgtgattcctttacttttgcgtcaccctcgtcatcacacaacacactcacgtcataataacttctacttactcaactgaaaaacgtgcttccaactaaaaaaaaaccataatactagtaattaagttttccaaccaaacacattagttgaaactctgttaaaagaaaatattagttgaagcttttaaggtttaagtaacagttataactgtcaaagcttttaatactaatataaaaatgtttttccgaattactactattatgtaaatattatttttttcattgctatgttatttgtgtttaatttgtagacgcacttaatgtaaaatgtttttccgtattattatctaaatattaaattttaattgctttgttattggagtttaatatgtagacacacttgtttagtaacttgtacactcacttattgtaaaatatttttatatgttttgtacaaaatcattttatcgctagattataataattattaagatgatgatgggataaatttcctctacaaaattgatgtgataaaataattaaaccctattgaatatttctatcaaaatattttacaataatgagcattgattaaacttatgatgtatattattacacgtataaaaaaattggcgtattattatgtatgtgataatcatacaattagaaatttattatcgaaatataaaaaaactaaaaaaatatatttattgattaacataacatatgtttgaattaattttatacaaaaaaagttagtagctgatttattattaaataaaaatcattttattttatcacatgtataaattaaattatttataacaaggatttttacttttcattttagtttcacaagtacaacctgtaaaaaaaataattaaatgttttattacacaacttatgtaaaaagcatagattttggaggaaaagtattataactacatgattttactagcatatattgtaatattcttgttatctgtgtttacagtgtaatataaatatagatatagtacggatacagataaaagataaagatgaatattatttatacttcaatgttcggaaggttgaccaatatttaattgggtccacatagaaatcgaaattggacgaaaaagggcaaacctcttgacgggtgaatacgtgctcctacgttgtggctaacaaaggatactatagtaaattcatcaaaataactgtatctaagtggcgcattttccggtgctagcggtcgcattttccattatacgctatatttctgcgtatttatctgttcttttggatattttaatttgggtactttttttgatgaattttttaatatgggtactgataacgttcaacctaaaataccaaaatagggtgcatgaaaacattaaaaagaagaaatttgaaagaaaaaaaaatactactataaagtgatacgatagagaatgagaaaattactttaatgcttttgataattaatattttaactcgtgtataatttataggtatttttcacattttattaatatttaaaaaatttaaaaataaatactaaagattttattttataaaataaatagcattcaaaagataaggaaatatattaattatttgtttattatatattgtttataaaaaggtcatgtgaatagtatcatcaagaaaaaaatcaagcttttatcatgtcaagaaattcttttattacttaaatacagtttaaaaattaaaaaagtatataaagataaaaaaaacgtattaataaaacattagaattaattaataactttctatttgattttttcaaaaataaaaataaaaataaaaaataaaataaagagtgagaaaaaatatgttactgtttattattatgaaagtcgatcatattcaaatgtttgatgttcaatatatataaagtaaacaaaactgtgttctcatttttttagtcatattttttaaaacttctgttaaaaaaagtcatatgtttcaatatatataatagaatttattttatttaaagagaagagcttgaaatgaacaagtgacagatatttataattttaaataaagaaactagtgaacatgtttttttaaaatattaataattttatatataaaaataaaataccaacccttcctttctcgtatacgacatacggaacttttttatttttaattaaataaattatactatttgtcttagaatcctatttttaaaataaattttgtaaaataaatttattaattgtttaattttattacagttagttatttaataagaaaatctatctcttagttgattataaaggatacagggttttttctgtccctaaattttttgtaaagttcacttttagtttcgaaacaattttttttttagctttttaccccttttattttttttatcaacaattttagtctcaattatcaagtatcacccataaccgatgaaataacagttatgtgtgactttcattgttattaattagtctaatgtaataattacttatgaaattttattttttgacaaattatatttttaatcttttatcaattagtctaataccactaattattttaacaacacacaggactaaaaatataatttataaaaaaaattacacatatttttctatatcaaaatcatcaataaggtgacaagttatgtaactaacaatgtaaatgtcaggttgtcaattttttcaacataaaattgaatattattaagaggatatgaaatatataaccatgtaatagagacatcatattatagactagcaaagacttactatcctaccaagaatgcaaaattatacaaaatctttaagacattccatagaacaagaatagttgttggcaaaagaaataccactaaaataaactccttacacctaaactaggtccactaaaatgacattgtgaaaattgttcctctacaaccatatacaccagcatgtagcataccaaactatataccaaaattgacacattttctttcccccctaaacaacaacctacgttgaacataatgttgttgcatctgattgtgttgagcctgacaaaatgccaaccattgatacacacatatccatacttggtaagaaaagtgattttggaagatcaagtgattcgtggtctccacaaattgtaagcacaacacaactagtaccatcgtttgcaactcctctgtgaggtaaagccacctgagttagcaaccaatctcgtaagagcctccttaaaaagacatgttggaaagggacacacacttccaaaaattcttcgatagaaatcctaggaaatctttgtttactattacatcaagagtaaaatagcatatgcagttgctactgagaattgttgagagccaccatgactctatacccaagaatcttgattgtccttggccaaggtaacaccaaacaaagtttgcatcagctagtcattcaattcttcctcccaacagaacaacctacatctccatttccaacaacactgccatccaaatgatgtccatacacccatatccaccattacgttatcttgtgtaagatagatgtgataaagatgacgaaaaaaaaagccattaaacaagtatcacctaaccatttatctttccaaaacaagatccttaagccatttcctacactttgagtaactaaattaagaaaccaacaatcatttgtctaaactcataacatccttccactcattagatgtatttctgactgaattattactactagaatttgaattcaatctctcatatttaaaacaaagcaaattataccatattgcatctttatcagacacaatttgccacctccattaaactagaagactgatattaaacaacttcaaatttttcactctaaaaccacttttaacttagggagacttgctgcttcccaattaacccaacatatcttctttgtctccaaaaaaccactccacatacaccatctttgtaattttatctactcatgttcaaagttcagacctcatttgaggcacagaatttcgtgctccttctctccttctccctccactcatcttcttctaccttcaaactcttatccatggcttcctatagtgatgagcttgttcttgactcatcttctccttaaagtgacgtctccaatcatttttcttcttctccatttcgctaccattgatcttaaagaaacaaaggactccattgataggaagatccaaggcctacaagctcaacatggagctacatcgtgtctttggggctttataacaagagaaataatataaaggaaaacataacaacatcgaattcaacaaagtaagcctccccctaaagacaaataacgccttttccactgaaacaactttttcttaaataagctaaaagttggatcatatgtggtagctcactcgggattagcaccaatgactattccaaggaatataaaaggcaacgttgcagtcgaacaatgaagaaatgttgatgccataaccataaaattatcatgctcattaacaccatatattttgcttttaagagagtttaccttttgtacttgccaaaaattggagccagactaacatcagagttgtccgtcgttagtgtgggtactctagtgatcttcgtggtggtgaatctgtcagtatcctctgcctgaggaatgaggagggagtaaaaggttaagttaaagtgaatatagaacctgattatttatagtgattggtgaaaatcctagggtgttgcctgagaggttgttgcaacatcataacaacctcattagtcaggtgtaaccgcattgcaacaactttgtaactaccttgacagccagatactcgcgtatcgaaatatcataatgacctaactacttagccatgtggcgctaaggttgaccttctagagaacatctgtgttcatggtctagggctgaccaagatggagggctaataaggactactcaatgctgcatcactcgccatgtcactcgtgaaccctggacagtacaccttcaaaccagagacaggctcaaagattcgtggaatggctttaagagcccacaagttgtcccaatatgcctcaccaaacatcatcaaatcatttgtgtattgtattaaagaaaaggaaataaagtcataaacttcaaagcctttaacccctacctgcctccacaaatttactaactaagtcattcaatcccttaaccattataagggacaaaaagacaccaaagaatcaccttgtttagaccactttcatccagaaactccattattagactaccattgaccaaagtagacatacaacttaagcaagttgctttaatccactttctccaagcactatcaaatccaagacagtccaacatataatcaaataatttatcattaacagagtcacgccatcaattaatgctacgacttaaaaaagaaaactaaattttttaacaaagaataatataaagacaaaaaaatgctaaaatttttgtctaaggactaaaacataatttaactatctaaaaaattattctcatttaagaatgtaagaaaattttattcttattcataatttaacatttaaaatatttgtattttcacacattaaatatcaacaaattttattcatacattactatctaaaaaatgttaacatatatttaatatttaattaatactaaacattatctagccaaaaaagaaacaagataaaataatgagtaacaatacaaccacaatgatattgctaataataaaagctacaaaaagaataataataatgatgataaattaaaaattaaaaaaagagggagcaagtgggggagttggccgagtcttgaagtataatcatcgtgcatgcattttggtgctgtctttcttctttcttatattctgcatgcacacgcctcctctctctctctctttctctcagtttcacccctctcttctctctctctctccggttaccatcgtccattcaaatctctctccggtttctctccgttcagattccgacaatcttccgatcacacttcattattcctctccacaacgcgcgaatgcgaatcccaaacctcacccctcgcggcacctcctccgcttaaaaattaacttccggtgaccggaacttcccctcgtgaacttccggcgaccggaggaaccactcgagcttcgctctcccgcttaatttcggtacgggcgcttctccgcagccggattttacatccggcgtcgcgcgagtcggtgaggtgacagttagggtttttcgttctgatttttctgatttttttttttgcagagtctgtgtggaattggagttgaaaatggagtcaaggagctgcatgaacgtggcgtgcgccacctcgacgacgattcggtggcgcaaaggctgggccctgcgatccggcgaattcgccgatctctgcgataagtgcgggtaatgatgctctagatttcgaatcgatgagcgtgtgttgaaattgacgcgtgagtttgatacgtggatgcacggaacacaacagttgattagaactttggagtaattttgtgatttgttgctttgttattgttaattatttgctgttttggggttttttttaatgtttttactttgaagtatttaatttagttatttcttaatctaagttttggcttgtggatacctttttttccttccaattttctaaagttagtgtagtggctttttttgctgatttttttttttttttgctgaatttcagtgtagtggcgtttacacgcttttatgtttttttttattatttattttttaaattgtgtggtaagtagtggaagacttgaagttgtcgtaggtaaaattgggtcgccgaattttaattgtggctgctgaccagagaccacaatttaaaacgttgtttatgacatgtgtttttatatggcatgcgtttattttttttttacacaattttatatggcatgtgtttataatttacagtattaattttccttacttttttttaataaatgacaaaaaagaaatacttgtgataaaatgggaacagagattaaaagaaaagaaaagaaaaaacatagtagttgtatagtaaccagtttgtccgattgta

SEQ ID NO: 175 - DNA, 6069 bp, Glycine max
  misc_feature (6051)..(6051): n is a, c, g, or t
caaatcccatcctcattaatacttcacaccacaactgttaacaaacacgattaagccaaaaaagacaataataaatgagaagaaaaaaaatcaactaaatgtaattagttaaaataagcccaaagatacatgttctatctatacaagtttagtatctatacaactttttagtaactattcaactatttaacttattaatcaatccactacccttaactaaaaaaacatgtaacaagcaatgttaataacaggaaaaagaagcattaaaagtcaaaagatgaaaggatgaaatttgaaaatactaatgaatataaagaggggcaagtttagttatgtaatttgtaaagaaacaagcgcttgatggtaatagaaagtagttttgctctgagaggtatacaactatagacttccactactaaaaaaagtactttttacgactgctgatctaccttgccctttaacgtattattcgaccttatcattttctgatatattttatttttggtcatgtcatggtcatcaagcttcgtggttagcaacgggtacacgaaaagagaaagagaggaacaaggccaagtttggatgagaacctggtttttactggtaaaggatgatcctggtttttactgcattttttatgttctgatgtatttgcttctaaactttgtatgttgtcttatgacttggcctaggtaaatcttgtacagtcttctagcttttttattaatgatatctctttgcttaattgcttagaaaaaaaaacccgagtaataattccttttcaaggaaattaaacaatggattttctcatctagtaaatcccatatatgattttgttcatgatttgtagtttaacatttaattttttttattgcgtaatgcttttcaaaatttaaaacccacttgcttataatagtgttagtgagttgactaaattgtccacattattttttcaattttttaagggtctgttagtggaaagaaatgaaaaaaaaaattaaagtgagataaaaatttaaaactaaagtgtagaaatgtgaatctcactttgttgatttctactttcttttatcctctttttctccaaacaacacaccctaattgactaaagttggttgtgttggcagagaagccgttcttcacaatttttattttttttaacaaagtcacaacaaatgaattagttggttaacttctcacaaagtacacatgcatgtcttaccttctaattgcctctattaccattgaacaagcttatagagcttcatataattgatagagacaaaaaaaattatatcattctatgaaatatataaatttacgtgatgttatgtaagttttttttttttaataatggattgttttttttaaggtgaccacattaacagagcttatctggtttttgaaaatttcttttgaaatttatctgtggtcctgtatatatattttgtttgcagtaagaatttatctaaattatccattcagagttgtgtgtgtagcaaaaataggacttctgataaaaatgtgttttcttcaggtcattctttttgataatcttaaaaaattagtacatgtatcgtaagaggttatctcctatgatctatcacttctcgttcaaatttgaaaactttgttttgcatatttatgctgttgtttgatgggtaggacccattgaaggagattatttttggacatgattgtgatgatttctagtctgagttgcatatgtttggttgtagggaaaaaggtgagcaaaggtcctaagatacaacggctggtcactcccctgaccctccaaagaaagagggcaaggattgcagataagaagagaattgccaaagcaaaatcagaggcagcagagtaccagaaacttcttgcctccaaaaaaataagcctaggtatatggaatatactgatatactctgaaggtgtttataacagttaactggtttttattacttaatagttcaggtttctattttaacttctgagtgtctagttaagcattgctgctatagtagtgctatggaactgaggaagcttcaacttgcacaaaataatacttaaaaattaaatagtaacaaatttattaaataaaatttggagcgtgttacacgttcgctggacttggctcgatgcatgaagcccactgagcccaggagtgtaatactattgtttaaatcaaactgacatttattactaatttgctcttaaactatttattgtggcaatcatagtgtcagacagtacttattgtgcaaccaaaaaaagtcagtccttgttgtcttggttattgcactgcagcgctctgttctgaactgctcaagcactgaccctaattatactaccagatcaaaatacttcatacagtataataatatattttgcacgtgttagatgaacaatatcgagggtcttgcctgttttttatttcctgtgattgatgcatacagtactattttcattttaattttctacatctatctttcgtaatagatggtttttatttcctgtgacacgctagaagtcatctctacttgaaataccataagacagtagcattttttcttgacagagattcaaattgtccagtgcttgattggtattgcttccacttggaatactacttacaatatttttcttgaaatttagaagaaaacaaaatgattacatgattaagttatcattttctttatattatatgtttataacattttattttttcattttgtacccaatgtatgatattataagttatcaaattagtaattgctattgccaggtcattttgaggtccttccattctgacttttgtctatgtttacaagaaattcgttggttaaactatttctttgtgccttatagttcctattttaaattttagtcattgcacaagaaaattgtgacttgtagtagccatatgagaaaacattaagtggtagcctctacacatgcataagaatttttagtttatactgtgatgagaaatcgcatcctgtcatccatgtcatacagtaccatactaataagttctagaaaactcttagttatactcagttgttatgacttgaacctgaaaatcaattttttgttgtaatcacaggttcttgaattgaataattaagtatagttgggacatcgtgttcgattttttattgctaaaggaaaggatcaatatacctccaatacaaggtaatgttgaaaatctccccatactacatcggttttacgataaacgatgtaaaaagctttcattttctacatcgattgattgataaccgatgtagcaacgttaccatatctagtcattctacatcggttgaactataactgatgtagaaacctttcattttctacatcggttgactgataaccgatgtagaaatctaccctttcaacatcgtttcagcctgagaaccgctgcagaaagttacccattctacatcggttgtagctagacaaccgatgtagaaaagccggccttcaaagacggtcataaaaccgatgttgtgattcaacgaccccgggttaccaccacgcgtcataaccgatgtagaaaggtcgttataaccgatgtacaaggcctttatttttagtagtggtttggtgttgttacgttacgctttggtggtgacaaaaagcttgtgagctgcatgttctcccgcccatatttggttttttcaaacttggaatgtagttaaaaaattttgtgttttattttttctgttggtcataattaaattatttgttttagttttaggtattataaagtttggatgttatatttattttaggtattttaagttattattcaaatatatggtatgttagtttgtatgaatttggaatatatattgtttaaatttttgttttgttattttaaattattttgggtattctaataacaaaaaaccttgttactaaaacttcaaattaaaactttattctaataaaaaattaattacttcaaataaatatcatgccaaaaacttaaaaaacttgtacgctttcaaagtagaaattttaaaggcacatcaaaccatcaactaagttgctattataaataattaatcttaaaactaataacttcaaaataagtaaatataattaaaaaaatactacactcaaactttagattaaaaatttattctaacaaaaaattaattatatgatgcagaaacttaaaaaacttgaacgctttgaaagtaaaaattttaaaggcagaacggaaacctttgaaagtagacattttaaaggcagaacaaatcattaaagaagttgttattataaataattaatcttaacattaataacttcaaaataaacaaatctaattacaaaaaatactcgaaactcaaattttattccaaactcaaaataattactttaaataaataaaaaaatgccaaagaaattaataaataaaaatgatgccagtcgaaactcaaattttattccagactcaaaataattacttcaaataaataaaaacgatgccagagaagagaaattactgattgagagaaactttaaaaacacttagaacactcagaaatttttaaaggcacaaagcatcagcacgaaagcatcaacatgaagttgctacttaaagggcacaacacacctattttgtcaataccattggcgatatatgctccttgtttcgccaacactgattgcaaaaccaacttagcctgaaccctactgccctactgttatcctgtgccctttgcaccttgcctgcgccctctgcaccgaaatctccagtcaaagtggcaaaaactgtgccagctatctcgccagtgacactggcggaatagccacatgtccagtgcaggcgtatttcgccatgcatgctgacgatatacatgcatgctggcgatatacatgcatgcatggctgaatctacgtaaaaaagaaacccccttgaaaatagttttaaaacagacctattctgggaattagtttgtaaaactaaccccattaggtcaatttagcgatgtttggcatgccatcattttcattgtccctaattctcaccaatctcatacccaaaagattttgtcactttgtaacaagggagctgttactaagatttaataaaggaccaaaagtttgaacgataaactatacagtatttttaacaattttaatatactattattatatttttatttaatatttaagaatatttctataatttaaactcatgcattaagtataaattaattttatattatcattcactcatatatcatcattaatatgatttttaagataattatcataattattatagatgataaaatattattgaatgaagttttaaatttgttttacaattttattatataacttattttttctatttatcaacaatatattacttttatagcctcatttgttgtcctatttctcactcccacatataagttaactttgttttttcttccttgaatgttttgtcacattgtaacaagtgaaattgttaagatttttaaaaaagcaaattgtttgaataataaattaaatttcaaacaattttaatatactaatattatatttttatttaatatttttaagttttcttagtatttaagaatatttattaacaagacctcttatagctatttttttatggaatgactattttttttagtaatgactatttttttttagtaatgagaatcttgcatttctattaactcactataataatgatgatgacgattgagttaagttcaagtgaagcgattgtatgcatgagtgtaaattagcttatttagttgaccagactttccttataattcacaaaggttgttacagaaatttgaaatttaatgtatctaatctaagtatattaatgcattaaaatatatatatatatatatatatatatatatatatatatatatatatatatatatatatatatatatatatatagattttaatgcattaatatacttagattagatacattaaatttcaaatttctgtaacaacctttgtgaattataaggaaagtctggtcaactaaataagctaatnacactcagcatacaatcg

SEQ ID NO: 176 - DNA, 65632 bp, Glycine max
atttaggtgacactatagaatactcaagctttacaatcggacaaactggttactatacaactactatgttttttcttttcttttcttttaatctctgttcccattttatcacaagtatttcttttttgtcatttattaaaaaaaagtaaggaaaattaatactgtaaattataaacacatgccatataaaattgtgtaaaaaaaaaataaacgcatgccatataaaaacacatgtcataaacaacgttttaaattgtggtctctggtcagcagccacaattaaaattcggcgacccaattttacctacgacaacttcaagtcttccactacttaccacacaatttaaaaaataaataataaaaaaaaacataaaagcgtgtaaacgccactacactgaaattcagcaaaaaaaaaaaaaaatcagcaaaaaaagccactacactaactttagaaaattggaaggaaaaaaaggtatccacaagccaaaacttagattaagaaataactaaattaaatacttcaaagtaaaaacattaaaaaaaaccccaaaacagcaaataattaacaataacaaagcaacaaatcacaaaattactccaaagttctaatcaactgttgtgttccgtgcatccacgtatcaaactcacgcgtcaatttcaacacacgctcatcgattcgaaatctagagcatcattacccgcacttatcgcagagatcggcgaattcgccggatcgcagggcccagcctttgcgccaccgaatcgtcgtcgaggtggcgcacgccacgttcatgcagctccttgactccattttcaactccaattccacacagactctgcaaaaaaaaaaatcagaaaaatcagaacgaaaaaccctaactgtcacctcaccgactcgcgcgacgccggatgtaaaatccggctgcggagaagcgcccgtaccgaaattaagcgggagagcgaagctcgagtggttcctccggtcgccggaagttcacgaggggaagttccggtcaccggaagttaatttttaagcggaggaggtgccgcgaggggtgaggtttgggattcgcattcgcgcgttgtggagaggaataatgaagtgtgatcggaagattgtcggaatctgaacggagagaaaccggagagagatttgaatggacgatggtaaccggagagagagagagaagagaggggtgaaactgagagaaagagagagagagaggaggcgtgtgcatgcagaatataagaaagaagaaagacagcaccaaaatgcatgcacgatgattatacttcaagactcggccaactcccccacttgctccctctttttttaatttttaatttatcatcattattattattctttttgtagcttttattattagcaatatcattgtggttgtattgttactcattattttatcttgtttcttttttggctagataatgtttagtattaattaaatattaaatatatgttaacattttttagatagtaatgtatgaataaaatttgttgatatttaatgtgtgaaaatacaaatattttaaatgttaaattatgaataagaataaaattttcttacattcttaaatgagaataattttttagatagttaaattatgttttagtccttagacaaaaattttagcatttttttgtctttatattattctttgttaaaaaatttagttttcttttttaagtcgtagcattaattgatggcgtgactctgttaatgataaattatttgattatatgttggactgtcttggatttgatagtgcttggagaaagtggattaaagcaacttgcttaagttgtatgtctactttggtcaatggtagtctaataatggagtttctggatgaaagtggtctaaacaaggtgattctttggtgtctttttgtcccttataatggttaagggattgaatgacttagttagtaaatttgtggaggcaggtaggggttaaaggctttgaagtttatgactttatttccttttctttaatacaatacacaaatgatttgatgatgtttggtgaggcatattgggacaacttgtgggctcttaaagccattccacgaatctttgagcctgtctctggtttgaaggtgtactgtccagggttcacgagtgacatggcgagtgatgcagcattgagtagtccttattagccctccatcttggtcagccctagaccatgaacacagatgttctctagaaggtcaaccttagcgccacatggctaagtagttaggtcattatgatatttcgatacgcgagtatctggctgtcaaggtagttacaaagttgttgcaatgcggttacacctgactaatgaggttgttatgatgttgcaacaacctctcaggcaacaccctaggattttcaccaatcactataaataatcaggttctatattcactttaacttaaccttttactccctcctcattcctcaggcagaggatactgacagattcaccaccacgaagatcactagagtacccacactaacgacggacaactctgatgttagtctggctccaatttttggcaagtacaaaaggtaaactctcttaaaagcaaaatatatggtgttaatgagcatgataattttatggttatggcatcaacatttcttcattgttcgactgcaacgttgccttttatattccttggaatagtcattggtgctaatcccgagtgagctaccacatatgatccaacttttagcttatttaagaaaaagttgtttcagtggaaaaggcgttatttgtctttagggggaggcttactttgttgaattcgatgttgttatgttttcctttatattatttctcttgttataaagccccaaagacacgatgtagctccatgttgagcttgtaggccttggatcttcctatcaatggagtcctttgtttctttaagatcaatggtagcgaaatggagaagaagaaaaatgattggagacgtcactttaaggagaagatgagtcaagaacaagctcatcactataggaagccatggataagagtttgaaggtagaagaagatgagtggagggagaaggagagaaggagcacgaaattctgtgcctcaaatgaggtctgaactttgaacatgagtagataaaattacaaagatggtgtatgtggagtggttttttggagacaaagaagatatgttgggttaattgggaagcagcaagtctccctaagttaaaagtggttttagagtgaaaaatttgaagttgtttaatatcagtcttctagtttaatggaggtggcaaattgtgtctgataaagatgcaatatggtataatttgctttgttttaaatatgagagattgaattcaaattctagtagtaataattcagtcagaaatacatctaatgagtggaaggatgttatgagtttagacaaatgattgttggtttcttaatttagttactcaaagtgtaggaaatggcttaaggatcttgttttggaaagataaatggttaggtgatacttgtttaatggctttttttttcgtcatctttatcacatctatcttacacaagataacgtaatggtggatatgggtgtatggacatcatttggatggcagtgttgttggaaatggagatgtaggttgttctgttgggaggaagaattgaatgactagctgatgcaaactttgtttggtgttaccttggccaaggacaatcaagattcttgggtatagagtcatggtggctctcaacaattctcagtagcaactgcatatgctattttactcttgatgtaatagtaaacaaagatttcctaggatttctatcgaagaatttttggaagtgtgtgtccctttccaacatgtctttttaaggaggctcttacgagattggttgctaactcaggtggctttacctcacagaggagttgcaaacgatggtactagttgtgttgtgcttacaatttgtggagaccacgaatcacttgatcttccaaaatcacttttcttaccaagtatggatatgtgtgtatcaatggttggcattttgtcaggctcaacacaatcagatgcaacaacattatgttcaacgtaggttgttgtttaggggggaaagaaaatgtgtcaattttggtatatagtttggtatgctacatgctggtgtatatggttgtagaggaacaattttcacaatgtcattttagtggacctagtttaggtgtaaggagtttattttagtggtatttcttttgccaacaactattcttgttctatggaatgtcttaaagattttgtataattttgcattcttggtaggatagtaagtctttgctagtctataatatgatgtctctattacatggttatatatttcatatcctcttaataatattcaattttatgttgaaaaaattgacaacctgacatttacattgttagttacataacttgtcaccttattgatgattttgatatagaaaaatatgtgtaattttttttataaattatatttttagtcctgtgtgttgttaaaataattagtggtattagactaattgataaaagattaaaaatataatttgtcaaaaaataaaatttcataagtaattattacattagactaattaataacaatgaaagtcacacataactgttatttcatcggttatgggtgatacttgataattgagactaaaattgttgataaaaaaaataaaaggggtaaaaagctaaaaaaaaaattgtttcgaaactaaaagtgaactttacaaaaaatttagggacagaaaaaaccctgtatcctttataatcaactaagagatagattttcttattaaataactaactgtaataaaattaaacaattaataaatttattttacaaaatttattttaaaaataggattctaagacaaatagtataatttatttaattaaaaataaaaaagttccgtatgtcgtatacgagaaaggaagggttggtattttatttttatatataaaattattaatattttaaaaaaacatgttcactagtttctttatttaaaattataaatatctgtcacttgttcatttcaagctcttctctttaaataaaataaattctattatatatattgaaacatatgactttttttaacagaagttttaaaaaatatgacttaaaaaatgagaacacagttttgtttactttatatatattgaacatcaaacatttgaatatgatcgactttcataataataaacagtaacatattttttctcactctttattttattttttatttttatttttatttttgaaaaaatcaaatagaaagttattaattaattctaatgttttattaatacgttttttttatctttatatacttttttaatttttaaactgtatttaagtaataaaagaatttcttgacatgataaaagcttgatttttttcttgatgatactattcacatgacctttttataaacaatatataataaacaaataattaatatatttccttatcttttgaatgctatttattttataaaataaaatctttagtatttatttttaaattttttaaatattaataaaatgtgaaaaatacctataaattatacacgagttaaaatattaattatcaaaagcattaaagtaattttctcattctctatcgtatcactttatagtagtatttttttttctttcaaatttcttctttttaatgttttcatgcaccctattttggtattttaggttgaacgttatcagtacccatattaaaaaattcatcaaaaaaagtacccaaattaaaatatccaaaagaacagataaatacgcagaaatatagcgtataatggaaaatgcgaccgctagcaccggaaaatgcgccacttagatacagttattttgatgaatttactatagtatcctttgttagccacaacgtaggagcacgtattcacccgtcaagaggtttgccctttttcgtccaatttcgatttctatgtggacccaattaaatattggtcaaccttccgaacattgaagtataaataatattcatctttatcttttatctgtatccgtactatatctatatttatattacactgtaaacacagataacaagaatattacaatatatgctagtaaaatcatgtagttataatacttttcctccaaaatctatgctttttacataagttgtgtaataaaacatttaattattttttttacaggttgtacttgtgaaactaaaatgaaaagtaaaaatccttgttataaataatttaatttatacatgtgataaaataaaatgatttttatttaataataaatcagctactaactttttttgtataaaattaattcaaacatatgttatgttaatcaataaatatatttttttagtttttttatatttcgataataaatttctaattgtatgattatcacatacataataatacgccaatttttttatacgtgtaataatatacatcataagtttaatcaatgctcattattgtaaaatattttgatagaaatattcaatagggtttaattattttatcacatcaattttgtagaggaaatttatcccatcatcatcttaataattattataatctagcgataaaatgattttgtacaaaacatataaaaatattttacaataagtgagtgtacaagttactaaacaagtgtgtctacatattaaactccaataacaaagcaattaaaatttaatatttagataataatacggaaaaacattttacattaagtgcgtctacaaattaaacacaaataacatagcaatgaaaaaaataatatttacataatagtagtaattcggaaaaacatttttatattagtattaaaagctttgacagttataactgttacttaaaccttaaaagcttcaactaatattttcttttaacagagtttcaactaatgtgtttggttggaaaacttaattactagtattatggtttttttttagttggaagcacgtttttcagttgagtaagtagaagttattatgacgtgagtgtgttgtgtgatgacgagggtgacgcaaaagtaaaggaatcacgtcgagtcgacaggtaaaagacaatgacagagccatctccatctgagttagtgccaatcgcacgcgtgattgctgtgcctggatttaaaatataaaatacatttaaatctatcttttattatttaaatatttttatgtttaaatatttgtacattatcttatgatatatttatttatcaaaataaatttgcaaactagtatgttaatttttgttgtatcttattttaagttaacataaattttttaacttaagataaatttaaaaatacacagagatagtattcgaatacagtttactatttgcgcatgacctaacattacgtatggattatgtaatacgcaaccaaaaatatctcgcggattttatcggttgatctttgttcaaattggcgatggccgaaagtgttatcttcaacatccttataatgattatgataatcaaaagacattttattttgttataattcattaatgatagacattaaatatgatttaaatttaattctaaatctttatatatatatatatatatatatatatatatatatatatatatattatttttttagttgtgattcagttttaatattttattatcaataaccatgaaataatgttatagaagatgatatatttattcacagtttcatattaataaaaattatatttctattttcttaacatatttatcttgttgatactatttaatttctattgatcgtcaataaatttatttatttttctttctcgcatgattgtgttatttgtgaccttaaagcataatatggagatagaattaatcaacataagtcatttgataatataagttaagtttatggattagaatttgagtttgatttttgtaaaatacattctttttgaaaaaaataataatttttaagtataattaagtctcacttctaattgaaaattaatcttataattaattcaaataatcaaagtttatgaacatacattagaatattattgggaacctaagatcctaattgcatatggtgatactaaataaaaaaaatgtacatacttcttaaattcaacgctgatacattaaaaaaaatcaacactagataaaattttgagtaagactttttctaccaggagacatatgatttttattaagtttttatgtgtaaaaatttgacttaattatacttattttctcatgtatcattataatataattttattctctaattaattgagtctcctgaatattataagtgtgagattttaatccttttgatagttggcggcattgattgatatggtattggcattaaactgagatagtgattaatttggcatcttatttgatttttaatttgacttgtttgattttagtccttgggagttttataatcatgtcattttagtttttttgtattgcataatgatagaattttagttttttaaagtgatgtagactaaaatgatgaaaacattcataaaatgttatagtttgattcaatcccatgtcacacattaatagtgtttattaaaccactatacctataacatttttttattataggtatacctaagcctaaataactaaaattataatatataagttaaatacaataatattaataatatcatttttataggtgactttaagcaattaattatactattcattcgttaactattttcttaattaattattttataatatttaaatacatattttccactttactaataacactgtttagtttttttttaatacggctttgtactctcatatgctattgaatcgggaaaaacacaatacaaattaagttaatttatgcaaaacaatttttttacgagattatgtaggaaatattataaaatttctatgaatattttgatgagcttaagaaaattaacaaaaccaatgttaattaattaatttctaccaggaaaaaaaaaaggcagaagccaatgaaatttaaggggtacagcaaagatttgtagaaccatcattaatattagtgcaacataccatgatgaagtgcatgacataataataatgtggagccaattgtgataagaacagaaaataaattagtgtaattgcatgatcagaataaagagaagatatatcatgttcatattgatcagaaaataaggcaacatgttaaagaaatgtgccaggtgcaacaatgagggaacaaaaaagagaaggataataaagaatgtggttatgacttttacaaaatcgaattatttacttttttaattttttatattttcctttttactttcctaatagttgtccgattaagaggaatttatggagtagattagattgattttgaaaaagagaaatatcatcttatacaatttttggtttttttaattcattgttcaattgatgtagtttaaaatttaaatatgatttaatcagtctagattgatctcaattttaagttttaattttatttctatttttttaaaaaataaatatttaagatatataataattgtgatacaaagtaatttaaaatatttctccaaaaaatgtaatttaaaatatcacatatatataaatcattttaaagctaatagtaatatttctataaaaaaagctaaaagtatatctctgttatataagttgataattatatttatatatacttgaatagttactgaatattataattaattaaatttacttttcataaataattttaagcaatgtaatatatatatatatatatatatatatatatatatatatgcttgtccctgctatatgttgatttttttttttagaaaacaatgtttttgacgagtgagatgcgatatatctattattgatgaatatcattattgtcttgattagacttgtgttgtttgaaatcctagagaatgtgaatctcagacatgaaagatatatgtatatgcataatgcgacttattgttgatgttgttattgatgaatttaattgatatgtggtgatgttgacatttatgatgatattgatttgagatgacgttgttaatgatgatcatgtcaacatgaattgatgttattattgatgattatgttaatatgaaatgatgtggttgttgttgataatgtcattgagatgatgagatgttgatgttgagagtgatattgaaatgagatgttgatgatgttggaaatgcgttgagatgaagcatgttgtgtatgttcgtgatggggtgcattgaccttgtcggatgtccctggtaggggaaaataaagtggttaaagagtttaagcatctctgaggggatgacttaggatctttaattcattcatggtcagtgtacttgatggtgcccacattttatacgttgtatgttgtgtatgttcatgggggtgcattgactttgtcggatgtccttggtgggggaaaatagagtggttaaagagttgcatgtgtacgacaggatgacctcgacacttattgtcttgtttttctaagtgagagtgtcgtgtggacacgcttatgctatttccttggggatggtaccacattgcatctaagagttgagatcaggtgcatgcatcatactgaacatgattaattggaactatgtatgaatgatgactatttgttgagtgtgtgttgattaatgaatgttgtataagctcatgatatttgttaatgttttcttgctaattgtggttatttgaatttagtattagttctttttataatgaactcacccttgcaattttgtatcgtgtggttgatacttgtgatgatcgcgaaccttgttcgtgggagcagaatgacagcagtaaggtgcagaaagtgagattctgatgtgaagtcgccgaactgacgtgatgacgttgagattattttgagagagagttgtgttttgttaatcaactccttcatagttggttccataatttttttgttgaattaaggatgtaaatcacaaacttaattatatgtatgaacaaatttaccttccattgtgtgaatgatgtgtactaagttactatgcctatatatatgtatgtattcatttaagtaatgatgcgttgtttcggaatgtatatcgtgaaattaaaattactttaatttttcataagcaaattaatggagtttttcatttaaaaattgaaatttttcgcagtttagagtggtgatatcgtaacgaagaggcgggccattacaatgagtgaccatactattagaatgaaaataagaaaattaaaaagttgagttagaaattttattatattttattttcaaagttaatatgtaatatatattcttgtgaccaacatgttattgcttagagtgaaactaaatctgttgcaaccaagtgactaagtgactgagtacaagtggttagtgtatttaaaataaagttgaatcgtttgaatattacctgagttcggcttaacagaaataattattggtaagactttacttagcttgtgactttagcatcatttcccatgatgaactgaaaagttaagacaaatccccttgagccaagattttagatttaagtcttacatattaaaaataattgaaaatagtgacttcgttaaagatgaataactaaatttctctatgaagatgagttatcagtatataaaattaataaatactttgtattaatgtcatggaaacaaatataatttatacttagtgcatgagtttaaattatagaaatattcttaaatattaaataaaaatataataatagtatattaaaattgttagaaaatacattataatttatcttttacagcagataaaaataattgtgaggagaaaaaataaattagaggataaatatttataaaactttaacaaactaataaaaaaagttttcatttttagagttatgtctatttatattacatgtaaagaaaatttaaatttttatgagtagttggatctaggactttaactacacaataatcattgataccaagttcacttaaatttatctcaacaattgataaaaacttatatttcataataattgttgatttaaaataaaaaaaaatattttatagaaattatatttattaaatatcataagagaaaaatatatctttttttaaatataataaaatattttcatttgctcatcatttctttgttgacttaaattttctttctctctcattttactattgttgtttgagataatctcattatttttttttacttaactaacagtaatatttttgtatagataagatttgaaggatgaaatttcataaaaatataaatcaaacaattacaataaatatgtaacatataaaagtagagttgaattaaatgatgattttttatgccacaattttaaaagaattacttttattcctccctctagataccgaaaacaccaatttacttaagtagagtaaggacaagaccagatatttctgaactttttatcacattcccaacctgaaaaaaacatgaaataaaaaacattaatcacagaagcaggaatcaaatggatagaatagtttgtaagtcaagactaacgtgttgaaggggccatttgcccagctgactgactataggatgtgtatcagtcaaaaccttcaaataccgagatgggttaaggtaatgcaatctatagcttaaaaggaatttagaagtgaaaaataatgtttgcttcatattatatctcagtcaatttgggaacaatcttaaggagacaccgagacaaatgttgaggagcacggtatgccatagcaccaagtacttgtacactactttgttttgtcctccaagctttaacttcaagaccccgaacaaatagattagctatgcgatagttcatcgaaatagatgttatggatagtaatttttttaatttgttcaatttacatgctatgttggaatgaaattaattgaaaagaagcattgggctgtaaacaaggttgcatttcggtttgcagtatatttgtttgtactgacccatgatgttatgattgctctttcatcttgcttagcagtaaacgatacataatattgcatgacttaaaaagaaaggcacaaataaggagatttgatgtttgcttgcagaatgcagattgatttatgcttgaaggctgacaccttgccattttatctcctttattgtattttaacatgatgttttaatgtttattgaagctcatcatattggacgtgccactggtagtgggctagtgacaaggtctttgggtagtttgcaggtgatactaggttcaaacatttgtgcaatcatttttaagtaattgcatttcatttggactaaaactggtatagtttattggattgacttttcaaaaacaccatgtcaatgtgtgcaacataattaaattaatatagatgtaaataaaatctcaataattagtcaattacatcaataaaataaataatgtcttaacaaaagaaaatccaaacaataaatctaaaatatgaaatttaaacatctctaacaataaatgattccatatttgaagtagcttgaacattctccatctccacatttaagagtacaacaaaaatgaatcagtcccaacaaaaataggataaaaacaaattctagagagagaagagatgtactttgcgtggtggcacggtggtgggccgaagctgtgtcgctgtggtgtgtcgcgtgactgcgtgaatatgagtcgcgttttgttttccttgtaagggaaagagtgttaaatatgatgtgaactattttttataataaaaatatattgaaatatctttaaaaatatttatttaacaattatttttagcttaaatgataagaattgatatttttattatttatgacttgcaaatatgaaaatgatagattaaaagaaaaaaagatcgagaaaatatcaaaaaggaagatttttagcatgttatcacttatatttttttatcttaatcttttatttctgttatcttttatttttcttatcttatcttttttatctttaccatcttttaatttaaatcttttatttttacctttaaatcttttatttttacctttaaatctttatcttatataatatatttcttcatttgttattttaaaagaaaagtttaaagtgaaaaagagaaaatcaaacctaatataattgggtcagggtcacacaaatcaaaccaaatgcgggttgcgggcaacccgtggaccccgcggccaaacccgcatagtccgcgggttaagcggggcggaccaaaaaatatgacataaccatgaactgttttaaaaaattggttcgtaactcgagcggatcgcgggcgccacgggccagtccatggacctgggcccatttacccacccctagtctacaggttcctgatcctttgcgattaagagatgaaccctagaggcacatcaatggcctctatggaacttctcatcgaatgtgaagcatagcccgtgcttatggcgcgaggctaactcctccggggtgagacgcctgacggtcggagcctatggcggggaaggcagcaaagggggcaaaggcgtgatacgagggggaaccaaaggggctggtggtggagctaccaacggtggggtcgcggccgcggtggaggcagacgaaggtccgatagcttctgctcctggatcttcgcaaggctggcggcctggtccacagtcataggctggtggacctggactgtgcggcggatctccgacgtcaaacccgagatgaagcaaggcaacaggaagggggccgacaagccgataattctattagccaagtcttcgaactccttcaggtatgttagcactgaacccgtctgagtgagtttgaacaaggcatcgacaggatcctcatacggtgatgaggcatatcggatttgtgcaggaacagaggtggagtggcaagggactggtgtggggttgggcgtggtggaggaaggcacaggagcaaggcggttgcgaagcttgtccatattgagggtcatagagtgcatggtattgtcaagacgaacaagggccttgtcgaggttgcgtgaggccatgaggacaaacgagagcaccaattgttacgaactgaacataaatgcaggaaattaagagctggcttcgaggcaccagaacctccagaggaagaagaagagcagagatgagagtaatttgctaatttcattcatatcgtgctgcttattacatgctattgtatttatactgatttctacataacagattttgtccttttgtgctagaggaaatcagaaatcgttattcttgtctcccttgcttctagcacagatcattcagcatcattccttaggatcacacgtagtccttaaggtaagcaggcttcgagatctttcttttggtattaactgctgcttgcacctccttttctacttgatttacacccttctttgctatagacacccctgtagttgctatgtcttgattcacatctattttttctgaatacatccctttgtatgctatgctatcactcttccctatcagagggggtctctggttttgtttttcctaattaccattatgtaagatctagcttgtatccgccttcttcttcttcttcttattacaactttttcacaatattctttactatattagcatctaggccaacctgataagtcacgcaccaccataataataatatttaacttttttttattttttaaagaaaaattaattcctttatttttttaaatattatttttatattaaaatatatttagtaaaacagtaatattaaaaaattaatttatttttaatgtaaaaataatatttaaaaaaataaaggaattaatttttctttttttaaaaaataaatttttatttaacaagttaaattaataaatgaattttttgtttatagtatttttttaaaaatgtataaaaactaattatatatatatttttaacaatttatttatactggaatacattacatcataaataaaatacatgaacaataatatttatctaagaaaaaactgaagatgaagatatattgaaataattttttctgttatgtttttattatcgaaaattttcacatttttttttctagaatgaataccatagttgttaggtaaaaaaactatggtaggttgtaacatgtctccttcccaaggattaataatcaaatgaggttgataatgggaatgattcatgtgttagttgtttatgctttcattattttcatgtttcaattattattgttagtccattctgttatttttgctttattatatgttccatttatgatgtttgtctctttaatttttaatattttatgttatttgagtattttaatttcttaatataatataattaagatgtgataatcatatatttattgggtttttaatcaatctatttttttaatcactttgttttttaaatttattttaagattattaattaattattttcaaactataaataaataattaaacaaaaaatattctcattatttaaaaaacaaaataataataataaaaaatttagttatttttttatctgaaaataatatttaaaaaacaagtaaattatttttaaaaaaatataaaaaaagaatttaataattttttttaaattaaaaaataataggagcaaagagaagttgggttccctaaccccgacttctctctgcaagctaaaaaggagtgttgtttaggaaacaattttgaggcaggtgtattttggaaaaaatgaggagagagcaagtgtagtggagtaaaaaaatcctgtaaggttttgtttggtagtaaaaagaaaaaaataattgtaatgagaaaaaataagttagaggataaatatcttcaacacttaaacaaacaaataaaaaagtttttctaggaagttcacttaaatctattttaactattgataaaaatttatacctgttgatttaaaataaaattatatttattaaatatgataggagaaaaaatattttttacatatagtaaaatattttcatttgctgaacttaaattttctttatctctcattttactattgttgtttgagatgatctcactgaatatattaataataaaatttttatataaataagattcaaaggataatcaccaaccaagaaattttatggaagtatttatcaaataattacaatagatatataacataaaaaaaagagttgaattgaataataatttttcatgccatcatttcaaaagaattactttaatcactctctttatattattattattattattataacatcttcacaatattttttattttattagtatttattgattttatttaataaaaaatcacacacttttctttttgcacacatctttaatctacatataaggatattcaaatcttgacttcattaatatatattattgtttttagggatcaattagcatgtgtcttttctttaattctttctcttttaatttgttcaacatttttattgtgttaataattttttaatctcatttttttattttcctcctaacaaaatttattctatatataagaattaataaagatttaaatcttttaccacttgattaaaaaacataaattactatcaattattttaactttttataaaatcatgattcagatctttatacaataacatatctcatcatgtgttagttgtttatatcatcactctttaaatctcttgagtctttagtttagaggagctaaattcaaaatagaaatatcaagaaagtaacatatgtgaggatcaaaagtaaagagactcccaacgtgataagtcacccaccaccataataatacaaataataaaaataaaaaagaccatacttttgtcttgcacagcagaacgagtgaaggtgaagagagttgacttaagccaaatctcatcacatcagttcatagcaaccaattcccttgcctttgtctttctactctgatcatcttttgttcttgagataatggctgcagcactggtcggtggtgcctttctctctgctttccttgatgtgcttttcgacaggctggcttcacctgactttgttgacttgatccttggaaagaagcttagcaagaagttgcttcgaaagttggagaccactctcagagtggttggagctgtgcttgatgatgccgagaagaaacagatcacaaacaccaatgtcaaacactggctcaatgctctcaaagatgctgtctatgaagccgatgacttactcgaccatgttttcaccaaagctgccacccaaaacaaggtaagaaacttgttttctcgcttttccgatcggaagatcgttagtaagttggaggacatagttgtcaccctagagtctcatttaaaactcaaggagagtcttgatttgaaagagagtgcagtggagaacttgtcatggaaagctccatcaacatctctggaagatggatctcatatatatggtagggagaaagatagggaggccataatcaagttgttgtcggaggataacagtgacggtagtgaagtgtctgtggttcctattgtgggcatgggtggggttggaaaaactactttggcccaattggtgtacaatgatgagaatttgaaagagaaatttgattttgattttaaggcatgggtttgtgtttctcaagaatttgatgttctgaaggtcacaaaaactataatacaggcggttactggaaatccttgtaaattgaatgatctgaatctacttcatcttgaattgatggacaagctgaaagataaaaaattcctaattgttttggatgatgtttggacagaggattatgttgattggagtcttcttaagaaaccatttcaatgtgggattattaggagaagtaaaattcttctaacaacccgcagtgaaaagacagcctccgtagtccaaacggttcaaacctatcatctaaaccaattgtcgaatgaagattgttggtcagtgtttgcgaaccatgcgtgtctttccttggaatcgaacgagaacacaacactagaaaaaattggaaaggagattgttaaaaagtgcgatggactgcctttagcagcacagtcccttggaggcatgttgagaagaaagcatgacattggggattggtataatattctgaatagtgacatttgggaactttctgaaagtgagtgtaaagttattccagcactgagacttagttatcattatctccctccacatttaaaacggtgctttgtttattgttcgttgtatccccaagattacgaatttgataaaaatgaattaatcttgttgtggatggctgaagatcttttgaagaaaccaaggaaaggtaggactttagaagaggttggtcatgagtattttgatgatttggtttcgagatcatttttccaacgttcaagtacaaatagaagtagttggccttatggtgaatgttttgtgatgcatgacctcatgcatgatctagccaaatcactcggtggagatttttattttagatcagaagaacttgggaaagaaacaaagatcaatactaagactcgtcatttgtcatttaccaaattcaattcttcagtcttggacaactttgatgttgttggtagagcaaaatttctgagaactttcttgtccattatcaattttgaagctgctccattcaacaacgaggaggcacaatgtatcattgtgtcgaagcttatgtacttgagagttttatcattttgtgacttccaaagtttggattctttgcctgattcaataggtaaattgatccatctgcgctatttagatctttctcattcaagtgtagaaacactgccaaagtcattgtgtaatttatacaatctgcaaactttgaagttgtgtagttgcagaaagctgactaagttgcctagtgacatgtgcaatcttgttaacttgcgtcatcttgagatacgtgaaactcctatagaagagatgccgagaggaatgagtaaattaaatcatctacaacatctggatttctttgttgtgggcaagcacaaagagaatgggatcaaagaattgggaggactttcaaatcttcgtggtcgacttaaaattaggaacttggagaatgtttcccaaagtgatgaagcgtcggaggcaaggatgatggataaaaaacacattaatagtttatggttggaatggtctagatgtaataacaacagtaccaacttccaactagaaatagatgtgctttgcaagttacagcctcactttaacattgaatcgttgagaataaaaggctataaaggaaccagatttccagattggatgggaaattcttcctactgcaatatgatgagtctaaaattgcgtgattgtgacaactgtagtatgcttccttcacttggacaactaccttctctcaaggtccttaagattgcacgattgaataggctgaagactattgatgcaggtttttacaagaacgaagattgtcgttctgggacgccctttccctcccttgaatctctggccattcatcaaatgccttgttgggaggtgtggagttccttcgattcagaagcttttcctgtgcttgaaattcttgaaatacgtgactgccccaaactagagggaagtttgccgaatcaccttcctgctctgaaaacacttacaattagaaattgtgagctgcttggctcttctctcccaacggctcccgccattcaaagtttggagatacgtaaaagcaataaagtagcactgcatgcgtttcctctcttggtagaaactataaaagtagaaggaagcccaatggtggagtccatgatggaggccatcacaaacatccaaccaacttgtctccggtctttaacattaagggattgctcgtcagccgtgtcatttccgggtggtcgtttacctgaatcactgaagagtctgtatatctcggatcttaaaaaactggaattcccgacgcaacacaaacatgagttactggaaacactgtcaatagaaagcagttgtgattcactcacatctcttccattggttacctttccaaatctcagagatcttgaaatcagaaactgtgaaaatatggaatctcttttggtatcattctggagagaaggattgcctgcgcccaacttgattactttccaagtgtggggctctgacaagttgaagtcgttgcctgatgagatgagtactcttctcccaaagttagaacgtctcctcatatccaactgcccagaaattgagtcgtttccaaaacggggtatgccacctaacctgagaatagtttggattttcaattgtgagaaactactgagcagcctagcatggccatccatgggcatgcttactcatctctatgttgggggtcgatgtgatggcatcaagtccttccctaaggagggtttgctgcctccctcccttacgtatctgtatctaagtggattctcaaatctggagatgttggactgcacggggcttctccatctcacatccctgcaacaattaaccatagacggatgtcctttgctggaaaatatggtgggagaaaggcttcctgactctctaataaaattaaccataaagagttgtcctttgctgaaaaaacgatgccggaagaagcaccctcaaatttggcctaaaatttcccacatccctggcattaaggttgacaatagatggatttagccaccaaggaggaccaacaggtatcttctaagtctaaccaactagaaaactagttctgtcaaggatatgtttcatttcatgtctttctccttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgataaatacttaaatataatgattctccggaaaaatgttacacatcagtattgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgacgtcaaattgacactttctcaatagctaaatttttatttgtgaggttttttgttaggtacaatgtgaaggatgaaaaggtgtaccaagtgaactttagaaggattggatgatttcagcttatctcttatctcctgtcctataaattaatagtggtatgattattctaaaaatatgatagatatgtagatacgtaagaattgataaaagcataataaatatacaattgcaattcggtaaattgaagaacatacatacttcttagacattgctaaaaacaaaatcaaaaaattgtagatcattttttcctattgttcacaaataagaatggtactatcaatgatcaatctcatttctttcttgaaattatctataaacaaaacaattttcatatttggttcatcaagaaacaatactttttatatttctatattatatttacttctatgttacatgtcactatatttgattatcataatttttttttaaaagaattggtcactttacatatatgtaccagtgaaatatatcaatatattggtatcggatatagatgcatgaagcaaattaaagtatcagtactttgtagcaaaacacattcttcaaatcatgacatgaggtaaaaaaatatgatgatatttttgtaagtattggaaaaaaaaaaaaaagtaaagcttctgaaatcaaagagacactaattttccacaacatccttcaattgggcccaagcttcctttcctattgacaaataactggttgttagtgccagctttttcttttttctagttttccattgatggttaaaagctaatatgaacctgtcactccttaaaatttccaccaaagtttggtaaataaatatataggagagtgaataatgcaagccttgcattctatctctaagttactaggtatatgaaacaggtatgggtatggttttagaaggtatgtggttcatcactatttatatttttactacaagaaccaggtaaactttattatggtacagtaaatttagtgtgaggttgtaactacgttatatccatctaacttagcacgataattaaatttaaaagcaaaaagataagaaaaaggccaatctaacaattgttacctctcttgcatgaaaaaatcagaaacaaaagccccactctttcctccatggtgcctgtaattaacaagcacttcaaaaatcaatgttaattaattaatttccataagaaaaaaaagacagaagctaatgaaatttaaggggtacaacaaagatttgtagaacgatcattaatattagtgcaacacatcatgatgaagtgcatgacataataataatgtgaaaccaatcatgataagaacagaaaataaatcagtgcaattacatgattagaaaataaagaggcgatatatcatattcctattgatcagacaatatgacaacgtgttaaacaaatgtgtcaggtgcaataatgaggggatagagaagagaaggatgataaagaatgtggttatgacttctacaaagtcgaattatttacttttttaattttttatattttccttttcacttttctaatagttgtccgattaagaggagtttatagagtagattaaattggttttgaaaaagagaaatatcatcttatacaatttttggttttcttaattcattgttcaattgatgtagtttaaaatttaaatatgatttaataagtttggattgatctcgatcttaagttttaattttaattctattttttcaaaaaaaaaatattaaagatatataataactgtgatacaaagtaatttaaaatattttaccaaaaaatgtaatttaaaatatcacatatatataaatcattttaaagctaatagtaatattttctaaaaagaagctaaaagtatatctctgttatacaagttgataattatatttatatatacttgaatagttactgaatattatatttaattaaatttacttttcataaataatttttaagtaatgtaataatttttatatatatatatatatatatatatatatatatataataaataaaaatataaacatcaatgatatcataaaattttggtaataataatttttaaaaaaaaattgtgaattaactaacctttcaggttctagagtaatttattaatccaaattgccttgaagcatattcccatgcaagtcaagttgagggacttgatggaggccatttctgaaatagagttaggagaagttattttcagccaacgagagattctgcaagctccctaatttaccaattcccaatggcaaggatgaggaaaagagtttataagagatatccaagaattcaaggcttttgaaatcagcaatgttgtcaggtagtgttcctcatatggcaaggatgaggagactttatttcatgtaaaaaatattttcctaggagtatatatatgatatatgattatgttgggtcatatttatggtatctcaaggtttcaattgacagttttggctatctcggaaattttccttgtaccaaaatattaacaattgaaacatgtttcaaatccagttacttttggtaccatagaattgaaattaatttatttcaaatacattgtattcttaatatattaaatatgttaatttgttattttttttaaaaaataatcattagaaacaagttccggtataggaggcatacttagtgtttaggctaaggaataatgccaccgggttcaggaacaagcctgttgaggtgtcccttaacgttccgtgacatccccactcttgcatggacattctgtgcagagaaacgatgggtggatggaggtaagattgggtgagttctataatagtcactgatgagaaccccaagagcagcattgaagttcgaggaatccaaataagaccagcgtaaattatcaatttcatctcttaaatagtcactaaaataaaatataaattaattctttcaagtattgaaacattcttcaaattaatccttatacattgataaaatatttcaatgtatatatgcattaatggatatttaacactttagaaattacttatatatgattttgttattttaaggactatttataagaaagagtaatactctagatatcaaattggtagttaatttaattactcttgaaataagcatgctcaatttataatatgttgttttgttggcaattaaataagcacaccctctctagaatggtgtgtatgtacttttctgtatatgttgttttgtttgtatacttttgcttgcatagatcccaaaacaattgggtgattttcattcttctataaattttcttataaatatttaagaaatttttgctaacacaagactggtgatatgatgttaagattgacataacaaggacgtgagagttcaatttttcacatgccatgtcacccatcatagtaccttgttggcatgtattaagtcaacaacaaacttccattttaaccatatctttgatcaccgcaaaaaattattaaatttactattaaattgtttatatttatttttctttattgttgggctgagatttttttagttactaaaattataaaagtttttttaatctctgaattttgataaattgttctttttagtttctgatttaataaattaatattttataataattttaaaatgaaaaattcaatggctaaaaaataaaaatcaattaatggttgctaaaacctaaaggatgttgctaatcagtgccctaaggcattagttaataaattaaaataaaaaaatatttattatgaaaatcataagagtatgtaaaaaaaatcataaataatactattttatatatttcaataaaaaaattattattttagttctttataaccaattaataccttaaaaacactagttaacatttaccataattaaattaactaattttgaaataaacttcaattattcaattatgtcttaataagcttgatttttcccttactactgcaagtttgcatcctttattaaagtgaagtgatgaaatgttgtctgccatttacgaatatcactgaaattaaagttgttttctagttgaatttataataagtttttttaattgataaattttaatcgttattttgtgagtttttgttagtataaggaagtaaagtcacaaattttcttttctttcataattttttaaccatcccatcaatattatatctccatttacaataagttaataactagcaagatacccatacatttacgcagatcgctctccttttttacgcatattcaaaatacacttgcttaaaaaagataattagctatttagtatttatattcaataaacatgaaaaaaggattagaatattcaagcaaaaaaaaaatcaaaatcctaatttttaggctatttaaatcattgtcttctattatttgaaaattgaaactattattcatatttttacctgttttatcttcataaattctattttaatatatttattatgtatttatgtaaaaaaatcaacactattaaaattaatttaatttgtgatattattcagtatttaatattttgttataaaaatatatttaataaattaatattaaaatatttcttatataattatgaaaaaatgatatttaaacttattttataaatattagttaataaaatttccatatatgaagttattaaaaaaagagacaaaataatattttgtaataaacatattacctaattagatttaaattaattaatagtataaaaatttcaactacataacataaattattcaaaaaatatttcattcataaaattattttatacggtttctaagtaaaattgattttataggatttcaaatttttaaaaagatatcgtggattctttaatatgttgttatgttaaatattcttaaagaaaaagctttgtcacccataataattggcctgtaatgacgttaaacacgtgattgtttttcatgaatgatatttttggtctctatcataaaaaatatatattaattaaatgtattattgagtaagtattttaaaagtattgtattaaaaattatatttaataattaaattttagtagttattatatattatgtagaagtgattataaagtaaaaatgggttttcaaattaaaaaaaaaatattatttttactctttgatatacaattgtgttaactactaggcgaaagaactgtgtcatttgtaataattttgagtaggattatttctcatcaatgattattaagatccctgtcatgattaaaatgattttaatttatgatattattaagtttttgatatgaatttgtgtgaaatacttgaagaaagagcatattcagtaagtaacctaaaactattttgtaataaaaatacattttataaattgattttaatatttttattactacatattatgtaaaaattaaaattaatataatttatgattttattgagtaagtaatttaaaattatattgtgataaaaatatatttaataaaatgttatataattatgtaagaatgatttccaaataaaaataatattataagatttgaaagtaaaaaaaaaaatactatttcagttttttttatgtgtagttgtgttaactacttggataaaaaaaatattgtggtctataatagtctttggcaagattttcttgtcactaatcatatttgtaatctctagcataactaaaattattataatatatgatattattaagtcttttggtatgtagttttataaaatattggaagaaatagttttgttgcatataataatccaatttcgagtaggattttttcttatgaatgatatttatgatttctactacaaaaatatttaaactaattaagtttatgagattattgacgaaatgatttaaaattagttttaataaaaatatatttaattaattaatttttaacatagagtcaaaacattattttgtaataaatttgttaactaattaaaattaaatttatttatagtataaaaatttcaaccttataatataaatattaatgaataaaatatttatttataagattatttaattttattttatatgatttctaattaaaactaattttataaaatttcgaattaaaaataaattgttgagtctttaatatgcaattgttttaattactcgcgaaagagttttttttttcctataatggttggcccataagaagaattatttttagtcattatcccaaagagaataaaactaatttaatttatgctatttcttagtaaataatttaattttttttaaaataaaaatactaagtgactaatcttcctcaagaattctgagtgcacataatttgactattcccctcccaacccaatttatttcatacacaaggatcaacggggactaatatattaattttaatatatctattatatatttacttaaaatgattttatagaatttaaaaataaaaataattattattgaatttttggtttgcatttgtgttaactactcagggtaggaacattgacgtccataatgacattgagtaagattgtatcccatcaatgatatttgtgatctctatcatatttaaaattatttaaatttatgatattgttaaatctttaatatgtacttttatgtgtgtttcgttgcatttgcacataagatctctagtaggattattttacttgaatcatccaaggttgttaaactcatgttttaaatcgtagaattgtatgattttacgattccactaagcttcagcgagttaaatcgaaagcagaattgaaaacggaatagactcatctgatttagcgcaaacttgggcgagtttgggtagactcgcgagtctgctacgagtatgtggatttacgaaaacccgaaacggtgtcgtgttgtagctacttatttgagtagactttgtctaccttgttcgagttatgcaaagtgcaaaattgtttggttcatgcttcttggcttcttgctgtgatgcagtcggtgctagagtgctacggtggggtgcgacggtgaaaggaggttttcggtgttggagtgcgactgtgcaagtgtgtgacacagtgcttctggatcttttgttggaaggaggttttcagtgaaaggaggttttcgatatatgggatcaaggtgatttgttgcgaacaaaagctaaacttcaaattgcacagggccagttaaggaacaaaagctatactgatatacgcagttgctagttgttcttcaaattcagagtaaaggttttaatttggttctgggaagaagctatacaaggtttgttgttgtaataacttatgctgattgaatatttctgaaccatgggcctttattcctgttatttactgttagaattggatgaatgcagtctcatgaaccttttgaatttattagatttttcaagaaatttgtgatcatgggtttgttagaaaaaaggaagtgtcctgatagtttgtaccttagaaagtgagaatattgatatataggaaagtaatagtgagagtattgaagatttgatcaccattttatttggtttgaaatggaggcatttcgtgaaaaagtagagtgcagaatgcatagagttcctcagaatttcgcatgtgttgatgaagctttttgaagcatggtacacctttaagggcatactactgttgggttcatatattttttggtttaatgagagaattgaagatttgatcaccattttatttggtttgaaatggaggcatttcgtgaaaaagtagagtgcagaatgcatagagttcctcagaatttctaacatactactgttgggtacaccttgaagcatattcccatgcaagtcaagttgagggacttgatggaggccatctctgaaatagagtcaggagaagttattttcagccaacgagagattctgcaagctccctaatttaccaattcccaatggcaaggatgaggaaaagagtttataagagatatccaagaattcaaggcttttgaaatcagcaatgttgtcaggtagtgttcctcatatggaattgttggacaaggagggtttcactactgacaaactgctaactcagttggagaatgttgtgtaagtgttaatgcaaaggacaataccgaaatgcatgaaaagatcatcatctcataacagactctttcacatacgaccgaccacctcaactgcaatggcatattttggtgaacgaaattgttctgactcacgtagattcaaagtgaatattcataaatcaggcattttctttgctttgtgacaatgtcactaaaccttcaattagttgatcttgttctagctctatagggtaataaaagtatatcaatgtctgcaaaatacatcaataagatcaagacaccaaaatatatatatgtgcttgaattatttataaacttttattttgattccgggttacaacttatcttaaaatattttcttttttctctgtttcttctttcaagtttttaatttaacttcctgggtaatctagattccataaaatacttctggaaatgcagatatgatcttgttttttttttttgtattttactattctatatattttatattagtgttgtttattttcttaaaattatcatacataattatatatgctatatacttgttgatagggaagaagatagaagctggttttcaaggaccagggcctccacggagagaagaatgagaagaataagggaaggaacaattgtatattccattgattgatgttgttattacatagtattatttatactgatttctcaataatcgaatttgtctttttgtgctacagaatatcaggaaattgttaagtttgtctattcctacccgaccagcatcattcttccagatatgatgcacctgcttgtttcacacctaatccttgaggtaagtgggtcttgtaattgctctcttggtcttgttttctaattgcacccccttgcttctgttgcttgcttgctgcaagttcccactgattcaaattccaacagttctgcaaataaaattgaagaagaagctagaggtgggaaatactcaagtcattctcttgaaaaagttgctgcaatgatatgcaacaaaatatcactatacggagtcaaggtaattattgtgttcacatgaacatttcttccatgaaaatatatatttttttactttgtaatctctttatagtatgcatggaaaattaattttctgatttttttctctgtagtgttatatattatttttaatcacattttcttatttattagtttgtttcttatttgacatcatgtaaatttggagatttgggttagaaatgtttttggaattttcctggttagaacttgataggtccataatgaaggtatataaaaggatagggaaaagagggggtggggaatagaaaaagaaaggacaaatgggcctcagaaacaagacatgcttgtgtatgacagcagaaagaatcagccgtacaagttgcactagctgaagtggaaaaggaacataggttggcataatggaatggatagcatttgatctttaataaatttttgctttgtaataggttcctaatatttaaaaagttttgtttgaaatacttatcattagtcaaaatctgttatttgctcacacgatcgttaaccagccacacagacatgtcatgtgtgatttttgtctgactgagattaggattaatgataagaaactatagtcaaaatcccttgggcataaaagaatcattcttcagcaaataacggattttgactaatgataagaaactatagtcaaaatcccttgggcatcaaaaaatcattcttcagcattcctctacgttttcacacaacccattatagtttcttctatacctttcttatggatttgtcactatgacttcgtcactcgtgaagatccaaggtgaagaggtcctcaccaacgatttttaggatcttgcaatcaattttacattttcaaatcaaaccaagccaactcccaactcaagaaattcacatggataaggtttctaagagaacacatcaaaatagtttcatgggtagaagaaggtcaacaaaaccttaccctaaaatgcgattccgctcggtccattgcatagagcacgaaaaaatgagtgggatagcgatgtctgaacttgtcgtcgacctttcatagttgcgagctctttttgcaaacccttgctttcatggttgtctcttcttgttctcccttcttaaaggtcaccaccaacccagccatcggccaccactggtgttgccagtcgtgccactgctcgtgccagcgccagctaccaccagtaacttccttcaactctcaaacctcacttctctcccagtctctctctcacacttggccctcaaactcacttgtgtgtcgtaggtgaagagaaggaaatgatgaaaacaaagaggagggttttctttggggaaggggggtccatgagtgattttttagagaaggagatttgttgttgccatggggagccatggttcaagagaagaaaaaaagaaaatgggttagaattattgttgtgttgctgccatggggtttcaagggaggtttggggggttttggagacacaatagcggtggtgtggagctagtggaggagttggttggggactggtgggggtggtttggaggattcggggacttaatgatgtcgtttttttacttttttctataaaaaaataaaaaatcttacgtgatcggttatcgatcacatatgaagataatggatttcgactaacggcaggaacttcgaacaaagctttttaaatattagggacctatcacaaagcaaaaatttattagggaccaaatgcaaaaaatgagtatttatcagagaccaaaaatatatttaaaccattacctaattgcaactcactatgtgataagtttgttgacttttaaaataattattttaaagtaattcaaacaataatttataatagtgtaaaatcattttacatcatcaatacataagtattaaactcgatatctctctctatatattttctgttcgagattgattgaaattatcttatttgcttaacatattaaaatgcgtcatttttaatgatattattggtctatagtttttatgtaatacatttaataatgtttagaaatatttgtatataaataacttttatctattttttcaccagagcctatgaaatgtaagcacaggtttgttaatgagtagcacaacatggacagtttgtcaaaggcccaatagcatctttaatgggattcttgaactcaagaaccctatccactagatctactattattcttattaagagttttttaagatggagattgggttctaggaaaagaactactattttttcaaaaatattattttttcttgtgctagtaaaatctaataatccaaattggattctactattagaataacaaatgatagaagttcttgcatcctatataacatcatgggactcacaaaaaataatccaagaacctaaaatggattctttgacaaaaatgttctaagaatctcaatattttcccacttaagaaatataactatcaaatcaatataatatgaaacgagttcaatctttattgattcacttgacgcaagctatatgcacaactgacataatagattttaattctaaataacatgcaataaaaatataacaaacctgttccggaaaaagcctcctcaaaatgaagcacattcagtccccccacaatttttacaagttggggtctttatgctgcatcaaaatattccatcatatcccgcaaatgtttcgtgctattaagtttatgttagttgtcccttcatgatgcatcaccagcatatcataaacaatcagttaatcccttattctgccgaaatagtcggattatcgtcaatcccccttaaggtggtcgtttgatcccgcttggcaaggcccaactttgaaagtgaattgacctaagcctcttttatgggcttgatgcgtgatagaagatcggaacataatccaatacattccaatctgaaccaaaagataaccccttagcttcaagcacacagtgcgtaaaagctaaagatgtagaagatcggaacatgatccgatctagaccagaacaaaacctaaaaccaaactactaactgatctataattttttatacatcataaaactaaaaaaacaaagcaaactaagcacataatcttacaatccctactgaatttactaaaagagacacagatagttgaggtgggaaatgttgccaaaccagaaatgaattatcacgggaaagtatggctgatgtggttacaattaggagtcttaattcatcttaaagcattaatattttttaacttaacaaatataattaaagagaagtaacgaataagataatgatctaaaattcttgtattgattgaaaatagcgtaaaaagatgtttcaaagataatgatacaaactctttaaatgcaaatggttacatgcacaaagcacgtatatatatatatatatatatatatatatatatatatatatatatatatatgaatatatctacgtacattcatatatgtatgtatatgcaaacatatatacatggatgcatatatatatatatgcactaacaaacatatatacatctggatagagagaggatcagaatagcaggacaaagacaaacttgtatttgttgcttccatactagaattgcattttcttcagggttagatgcatcaactgtgtgggagggaaatttattaacagcgctaagtattctcctaaccttaagcaggatctccttctggtctcttgccatctgagcttgcatgtcaatgatgaaaaacctgacaagcgagtccgcaagtgcctcaagttgttcctggtaacaagctttgtcgcattgaccgaaaaaaccaaggtgacgttgaccaaaaaatagtcctgacaagatgttggtaaaaaaatataatcggttgatatcgatcacaaacatcattgactaaggttaacaaaaaaatttctaaccgacattgatcaaaaaataacttcgaccaaggtcgatcaaaagaaacgtaaccgatttcggccaacagaaatattttatatgatagcctttagttgcaaaaagtgtgaaccagggggtattttgacagccgtaaaacatatctcatggcagtggttgttatataaggcaaaaaaccatgaactttcttctcttgctggtgtttggagccacttcaaatgtgattgatgttagagaagttaacagtggcattttttaggactgaaagttaacttaggagaaaccatttttttatgtatgtaatacggtaacacatgtacctcttgcagagattggggagaaattgcaacttttctttttacattttgccttaaaaaaagtgttcatatttataaaaataattttctatttaacttggatattttttctcatactactacactaaggtatatacaacctaaggcgtgtttcttaatttggagagtgatgcttgattgattgactaccaacgaaggataatctaaaaaggagaaacaccatttataatcctcatgagtgcttatgtcccttttgccttgaggtagatgagtcggtatctcactgtttcttctcatgtcataaaattcttggtactaatttggaggcaatgttactcttggctgctggctgcatgtaaatgtggtgttgccacaatgaccagaatcacatttttggcaagattctgtattcgtaagttcaaagaaggaggcagatgtatggagggcggtgtgggcatcagaaattttggtgtgtatggaatgctaggaatgagtgtatgctaaggaattaatggctctttcaatgctgagaaaattacgcagaatatattattctttgcacgatcgtggattaataaaagccagagtccctaattttaattattgttttacttaatgatatatggcacctggagcttgtttcatgaagagacaattttgaatgaaatgtgaagttaatttgattcggtggtagctgctcttcgagtgggatcatcccaaatgcaaccgatgtttatgtgcacgatggtgggggctggttagtgatgccgcatcaatgttgcatggctttagacatgattttaaattgcaattatgattgcgttgcatgcaacgaacctaaaaatcttacattgtggataattatggaaaaatacaaactgatgtgatcataattataattgtgatgtgattacagagtcaaaatacattagcgttatgactgcaattatggttgctgactacattttaaaaccatgactttgggtgtaatggtccatgttcgaagctagctatctttctttctactgtcactggtgtatatgtttttggatcttaggtaattttggtaccatttaatacaaatcattttgttggaaaaaaaatacggtagcctacatgcaatatacaaaataaaattgaattactatatattatcataaatagtagagtataagaagtaaagaaaattctaaagataaacatgcatttaaaaacatatgaaagaattttttaactatatatataacatctttaattagcttaatagaaatgcgaaagtacaataaaaaagcaaaaacataataggcgtgacaaatcggttgcttatatacaataaagacaataaagtttgaaactaaaaccttatccagactatccaaatatccctaattaatcatgaaaaaattagaacagaagacatttaataactatagcaacagtaacagcagcagctatagctaatggcgcgatcaccgaatcggaaaacttttcatcattgaagtattctatttcactaaccctaagcaagatctcaagttgatcgcgtgcaataagagctggcatttcaatattgaaaaacctctcaattgagtctgcaagatctttaattttagttttccacggtaagaattcttagccacaaaattgtatttccctatttttgaacacttgtaaacaacctctttgctcttcctcaatagttgtatcagtggctcaagttcctgctgtgaacgacccaacatattcctgtacttacctatctcctgccatgtttacgctacatattttctagaatgttatttgaatttcattaaaaatcataagaagcaagtttgaatttttcagtgaaatttttacttaggtttagttagacaaaccctatttaaagctatattgttttgcttatcggaaccaaaccaattagttcggtttgaatttcttagttaaatcaagtctggcttaaaccaaatcgagctaaccctaggttaattgtttcaaaggtcgggttgaagctctttaaacttgagaatgtgttctacaaaccgaagtaccttattatttaaagaatatctaatatttttttgtttttacattattgttgaatccattttatatgattttttttttacaaaatattaaactttatttactaaataagatttatataaaattcatgaaggtaaaagtaatatttttatcttttaatgtaaggcttggtttcactttcgtccttcaacttttttttatttgatttatttcagtgatcatttaatatttatggattcttccttaaggaatcttgatatttttctatagttttaattgttcttcggttatttattcggaaattgagaggggatcatcacctccaaagatttcctcgctcccattaacaaaaatgtctaaacaattaccttccttctaaaatttttgtgaagtacctccactaattaaactcaacatattctcccaaacttcattttctttgaaaacaatgttgtctaattcaagacgctttgatataaaatatttagtcgctagaacgagaaaaaaaattgaataaaaagaagggatttttttcttcttaatgtacttcatgctacttatttgttggcaatcattattaatatatattatcttatatgagacaattttcaacatttaaatgttaattttgtaagtatcttggtagtatccttttttgataaggaatagatattattttgagattatattatgatgatgaattgtctcataaaaacacgaggcaagcacttgaaaggaacaaattctctaatttcttagtgggtagtgggagagaggaagtaaacttgcttcaatatgcaaatgacgcttgacgcactctttacaggagaagcaaccatttctaaggtgcttaccataaaaagcattttgagaggctttgaacttgtctcgggcctcaaaatgaatttccatcaaggcttttgtggtgccttgggagtggatattgataccttgatgaattatgcaagcttgttgatttacttgagacaaactatatgcacaactgacaaaatggactttaattctaaatagcaataaaaagatatataataaacctgtttcagaaaaggcttcctcaaaatggaggctacttcaatctagtacggtagttgacttactaagtacgaaacaacaaattattaagttgataattaattaaacatgattttaaatacttacatatttattcacatgtaactataaagatttagtaagagcataaataaaaaatgttgttataatatataattttaaatttaatataataaaaatgtgtttgcaaaatagaaatataaatataaagcgtgacaacacatgtttttcgttaataataataataataataataataataataataataataataataataataataataataattacaaatgggttttgacaaaatcatacctggcgaaaatatgcagtttagtgacggaattaatttgtgattcatgcaatacaatttgtaccaatcatcatcatcatcataatctctttttcgttttatttatcaacgttgctacttagtacgaaaattatttgcacaaaatacaaacagaatgatgctatctgttatgaaaggtaaatccacacgaattacacgaaatatagaatggacggttatgattttataaaatgaatatcgattaaaaaaatttaaaaggcatgtaaaaagagatttacagacatcaaacttcgtgcgacttttacaaaatcctctttcctaacacagcattatattttccatacacaaaccgtaaactatagattctaaagggtatacctgacttattaacaactttttaaaaactaatattcattaaaaataccaaataggttttgacataatcacacctcgtgcagatttgacaaaaaagaattcttacaatttatttttcctcaaattggtgttaaaattaaatatatgtgactagtcaagtaggtgataacaagttgcagcacttgtatatatgagtgatgcaaaggattcgtgcaatttatttacgaaaattatatattggcatgaaacacacgaactgtaaactatatatagtcactaacttgtatacgtacgaactgtaacaataaattttaaaataaaatattaattacaaatataaaatgggttttgacaaaatcgatcacacctcgggcagatttgacaaaagataattcgccacgaattctttttcgtcaattatttaacacaaccttccttttacgaattgcacaaatccacttttaaaatacaagaaaattttgttttaaaaattcagccagccgacatagaggtgtatgcaggtaagtttggattgagtttcatcatacctatgacttaagaatgagttgatttgagtcatttgtatacgattttaattaaattattgggttaaaatatttaaatttgtatgctatttattaaatccaatatttatataagctaaaattcttattaattagaatactgaaaacattacttataaattaaatattgtcagatgctgcgactaagtgaggtggtggaaagatgtcaagagttgaactctaatttttgaaagaataacaatgacactcggtacttattcaactctcttgttatgcacgaaacatatatttaataataaattcacgcgcgtatttataaaattatatgagaattttttgtataaaaatttaaacacataaattatattaaattaaaatgttatggtaattttaaaatatgaatgataaaatgattcaattattatactttaatttttaaataaaaattgatttttataatatttaaagtttataaataatattttgaataattttacatataaattaattaaattaaatgcaaaaaactgaaattaaatatttcttaaaactaattaattattatatgaatcactttatattagtaattgcgagctgcttgtctcttctctcccaacggctcccgccattcaaagtttggagataattaaaagcaataaagtagcactgcattcgttacctctcttggtagagactatagaagtagaaggaagctcaagggtttttattttaaaaaatatataaaaaatgaatttaataatttttttaaattaaaaaataataggagcaaagagaagttgggttccctaaccccgacttctctctgcaagctaaaaaggagtgttgtttaggaaacaattttgaggcaggtgtattttgaaaaaaattgaggagagagcaagtgtagtggagtaaaaaaatcctataagattttgtttgatactaaaaagaaaaaaataattgtgatgagaaaaaataagttagaggataaatatcttcaacacttaaacaaacaaataaaaaagtttttctagaaagttcacttaaatctattttcactattgataaaaatttatacctgttgatttaaaataaaattatattttataaaaattatatttattaaatatgataggagaaaaatattttttacatatagtaaaatattttcatttgctggacttaaattttctttatctctcattttagtattgttgtttgagatgatctcactaaatatattttacttgactaataataaaaattttatatagataagattcaaaggataatcaccaaccaaaaatttttatggaagtatttatcaaataattacaatagatatataacataaaaaaagagttgaattgaataataatttttcatgccaaattactttaatcactctatattattattattattatcattattataacatcttcacaatattctttattttattagtatctattatttattttattaattttatttaataaaaaatcacaaacttttctttttgcacacatctttaacgtacatataaagatattcaaatcttgaattcattaatattatgtttttagggatcaattagcatgtgtcctttctttaattctttctcttttaatttgttcaacattttttttgtcttaataattttttaatctcatttttttattttcctcctaacaaaatttattctatatataagaattaataaaaatttaaatcttttaccacttgattaaaaaacataaatcattatcaattattttaaatttataaaatcatgattcagtattagatctttataaaataccatatctctatgacaattttaatgattaggttgaaatataaactaacacgaatttaagtaaatatttcactatttactttcacattgaaaaattgattttaaattttaactttagaaaaaaaattctaagttgaggatctttacataacttttggatttaacaaaaaaattcattttcaattttactattaacttattttttaaataaaaatatccaaaacacatgtgcaaactgcttcaatacaacttgtctcacagcatcaaagcacaggaacataattatgcacagtacccttgcagccatccacacatatcaccaagaaaaaaacacacaccactgctccacacggtttggaaagcgagaaagctggccatcactaactttaattatagcattttagaaatataatccatttttttaaaattaacggtagaaatatcatcactctttaaatctcttgagtctttagtttagaggagctaaatttaaaatagaaatatcaagaaagcaacatgtggggatcaaaagtaaagagactcccaacgtgataagtcacccaccaccaattcccttgccttttgtcttgcacagcagaacgagtgaaggtgaagagagttgacttaagccaaatctcatcacatcagttcatagcaaccaattcccttgcctttgtctttctactctgatcatcttttgttcttgagataatggcagcagcactggtcggtggtgccttcctctctgcttttcttgatgtggttttcgacaggctggcttcacctgagtttgttgacttgatccgtggaaagaagcttagcaagaagttgcttcaaaagttggagaccactctcagagtggttggagctgtgcttgatgatgccgagaagaaacagatcacaaacaccaatgtcaaacactggctcaatgatctcaaacatgctgtctatgaagccgatgacttactcgaccatgttttcaccaaagctgccacccaaaacaaggtaagagacttgttttctcgcttttccgataggaagatcgttagtaagttggaggacatagttgtcacacttgagtctcatttaaaactcaaggagagtcttgatttgaaagagagtgcagtggagaacttgtcatggaaagctccatcaacatctctggaagatggatctcatatatatggtagggagaaagataaggaggccataatcaagttgttgtcggaggataacagtgacggtagagaagtgtctgtggttcctattgtgggcatgggtggggttggaaaaactactttggcccaattggtgtacaacgatgagaatttgaaacagatatttgattttgattttaaggcatgggtttgtgtttctcaagaatttgatgttctcaaggtcacaaaaactataatagaggcggtgactggaaaggcttgtaaattgaatgatctgaatctacttcatcttgaattgatggacaagctgaaagataaaaaattcttaattgttttggatgatgtttggacagaggattatgttgattggcgtcttcttaagaaaccatttaaccgtgggattattaggagaagtaaaattcttctaacaacccgcagtgaaaaaacagcatctgtagtccaaactgttcacacctatcatctaaaccaattgtcgaatgaagattgttggtcagtgtttgcgaaccatgcatgtctttccacggaatctaacgagaacacagcaacactagaaaaaattggaaaggagattgttaaaaagtgcaacggactgcctttagcagcagagtcgcttggaggcatgttgagaagaaagcatgacattggtgattggaataatattctcaatagtgacatttgggaactttctgaaagtgagtgtaaagttattccagcactgagacttagttatcattatctccctccacatttaaaacgatgctttgtttattgttcgttgtatccacaagattacgaatttgaaaaaaatgaattaatcttgttgtggatggctgaagatcttttgaagaaaccaaggaaaggtaggactttagaagaggttggtcatgagtattttgatgatttggtttcgagatcgtttttccaacgttcaagaacaagtagttggcctcatcgcaaatgttttgtgatgcatgacctcatgcatgatctagccacatcactcggtggagatttttattttagatcagaagaacttgggaaagaaacaaagatcaataccaagactcgtcatttgtcatttgccaaattcaattcttcagtcttggacaactttgatgttattggtagagcaaaatttctgagaaccttcttgtccattatcaattttgaagctgctccattcaacaatgaggaggcacaatgtatcataatgtcgaagcttatgtacttgagagttttatcattttgtgacttccaaagtctggattctttgcctgattcaataggtaaattgatccatctgcgctatttagatctctctttttcaagaatagaaacactgccaaagtcattgtgtaatttgtacaatctgcaaactttgaagttgtgtagttgcagaaagctgactaagttgcccagtgacatgcgcaatcttgttaacttgcgtcatcttggtattgcttatactcctataaaagagatgccgagaggaatgggtaaattaaatcatttacaacatctggatttctttgttgtgggcaagcacgaagagaatggaatcaaagaattgggaggactttcaaatcttcgtggtcagcttgaaattaggaagttggagaatgtttcccaaagtgatgaagcgttggaggcaaggatgatggataaaaaacacattaatagtttacagttggaatggtctggatgtaacaacaacagtaccaacttccaacttgaaatagatgtgctttgcaagttacagcctcactttaacattgaatcgttggaaataaaaggttatgaaggaaccagatttccagattggatgggaaattcttcctactgcaatatgattagtctaaaattgcgtgattgtcacaactgtagtatgcttccttcacttggacaactaccttctctcaaggaccttggaattgcacgattgaataggctgaagactattgatgcaggtttctacaagaatgaagaatgtcgttctgggacgtcctttccctcccttgaatctctgtccattgatgacatgccttgttgggaggtgtggagttccttcgattcagaagcttttcctgtgcttaacagtcttgaaatacgtgactgccccaaactagagggaagtttgccgaatcaccttcctgctctgacaaaacttgtgattagaaattgcgagctgcttgtctcttctctcccaacggctcccgccattcaaagtttggagatatgtaaaagcaataaagtagcactgcatgcgtttcctctcttggtagaaactatagaagtagaaggaagcccaatggtggagtccgtgatcgaggccatcactaacatccaaccaacttgtctccggtctttaacattaagggattgttcgtcagccgtgtcatttccgggtggtcgtttacctgaatcactgaagagtctgagtatcaaggatcttaaaaaactggaattcccgacgcaacacaaacatgagttactggaaacactgtcaatagaaagcagttgtgattcactcacatctcttccattggttacctttccaaatctcagatatctcagcatcgaaaagtgtgaaaatatggaatatcttttggtttcaggggcagagtcatttaagagtctgtgttatttgttaatttacaaatgccccaactttgtatcattctggagagaaggattgcctgcgcccaacttgattactttcagtgtttggggctctgacaagttgaagtcgttgcctgatgagatgagtactcttctcccaaagttagaagatctcaccatatccaactgcccagaaattgagtcctttccaaaacggggtatgccacctaacctgagaagagttgagattgtcaattgtgagaaactactgagcggcctagcatggccatccatgggcatgcttactcatctcaatgttgggggtccatgtgatggcatcaagtccttccctaaagagggtttgctgcctccctcccttacgtctctgtctctatatgacttgtcaaatctggagatgttggactgcacggggcttctccatctcacatccctgcaacaattacaaatttttggatgtccaaagctggagaatatggctggagaaagtcttcctttctctctaataaaattaaccatggtggaatgtcctttgctggaaaaacgatgccgcatgaagcaccctcaaatttggcctaaagtttcccacatccctggcattaaggttggcaatagatggatttagccaccaaggaggaccaacaggtatcttctaagtctaaccaactagaaaactatttctgtcaaggatatgtttcatttcatgtctttctacttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgacaaatacttaaatataatgattctccggaaaaatgttacacatcagtgttgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgatgtcaaattgacactttctcaatagctgaatttttatttgtgaggtttttcgttgggtacaatgtgaaggatgaaaaggtgtaccaagtgaactttagaaggattggatgatttcagcttatctcttattccctgtcctataaattaataatggtatgattattctaaaaatatgatagatatgtagataagtaagaattgataaaagcataataaatatacaattgcaattcggtaaactgaagaacatacatacttcttagacattgctaaaaacaaaatcaaaaaattgtagatcatttttttcctattgttcacaaataagaatggtactatcaatgatcaatctcatttctttcttgaaattatctataaacaaaacaattttcatattggttcatcaagaaacaatactttttatatttctatattatacttacttctatgttacatgtcactatatttgattatcataatttttttttaaagaattggtcacttcacatatatgtatcagatatattggtatcagatatagatgcatgaagcaaattaaagtatcagtactttgtagcaaaacacattcttcaaatcatgacatgaggtaaaaaaaaataagatgatatttttgtaagtattggaaaaaaaaagagtaaagcttctgaaatcaaagagacactaattttccacaacatccttcaattgggcccaagcttcctttcctatggacaaataactggttgttagtgccagccttttctttttaccagttttccattgatggttaaaagctattatgaacctgtcactccttaaaatttccaccaaagtttggtaaataaatatataggagagtgaataatacaagtcttgcattctatctctaagttattaggtatatgaaacaggtatgggtatttggttttagaaggtatgtggttcatcactatttatattattactacaagaaccaggtaaactttattatggtacagtaagtttggtgtgagttgtaactacgttatatccatctcacttagcacgataattaaatttaaaagcaaaaagataagaaaaaggccaatctaacaattgttacctctcttgcatgacaaaatcagaaacaaaagtcccactctttcctccatggtgcctgtaattaacaagcacttcaaaaaccaatgttaattaattaatttccataaaaaaaaaaaggcaaaagccaatgaaatttaaggggtacaacaaagatttgtagaacgatcattaatattagtgcaacgcaccatgatgaagtgcatgacataataataatgtggaaccaatcatgataagaacagaaaataaatcaatgcaattgcatgatcagaaaataacgaggcgatatatcatgttcctattgatcagacaataggacaacgtgttaaagaaatgtgtcaagtgcaacaatgagggaacggagaagagaaggatgataaagaatgtggttatgacttctacaaagtccaattatttacttttttaattttttatattttccttttcactttcctaatagttgtcggattaaaaggagtttatggagtagattagattggttttgaaaaagagaaatatcatctgatacaatttttagttttcttaatttattgttcaattgatgtagtttaaaaagttgcactaactgaagtggaaaaggaacataggttggcataatggaatggatagcatttgatctttaataaatttttgctttgtgataggttcctaatatttaaaaagttttgtttgaaatacttatcattagtcaaaatccgttatttgctcacacgatcgttaaccagccacacagacatgtcatgtgtgatttttgtctgactgagattaggactaatgataagaaactatagtcaaaatcctttggacatcaaagaatcattcttcagcaaataacggattttgactaatgataagaaactatagtcaaaatcccttgggcatcaaaaaatcactcttcagcattcctctacgttttcacacaacccactatagtttcttctatacctttcttatggatttgtcactatgacttcgtcactcgtaaagatccaaggtgaagaggtcctcaccaacgatttttaggaccttgcaatcaattttgcattttcaaatcaaaccaagccaattcccaactcaagaaattcacatggataaggtttctaagagaacacatcaaaatagtttcatgggtagaagaaggtcaacaaaaccttaccctaaaatgtgattccgctcggtccattgaatagagcacgaaaaaatgagtgggatagcgatgtctgaacttgtcgtcgacctttcatagttgcgagctctttttgcaaacccttgctttcatggttgtctcttcttgttctcccttcttaaaggtcaccaccaacccagccatcagccaccactggtgctgccagtcgtgccactgctcgtgccagcgccagctaccaccagtaacttccttcaactctcaaacctcacttctctcccagtctctctctcacacttggccctccaacccacttgtgtgtcgtaggtgaagagaaggaaatgatgaaaacaaagaggagggttttctttggggaaggggggtccatgagtgatttttgagagaaggagatttgttgttgccatggggagccatggttcaagagaagaaaaaaagaaaatgggttagaattattgttgtgttgctgccatggggtttcaagggaggtttggggggttttggagacataatagcggtggtgtggagctagtggaggagttggttgaggactggtgggggtggtttggaggattcggggacttaatgatgtcgtttttttacttttttctataaaaaaataaaaaatcttacgtgatcggttaacgatcacatatgaagataatggatttcgactaacggtaggaacttcggacaaagctttttaaatattagggacccatcataaagcaaaaatttattagggaccaaatgtaaaaaatgagtatttatcagagaccaaaaatatatttaaaccattacctaattgcaactcactatgtgataagtttgttgacttttaaaataattattttaaagtaattcaaacaataatttataatagtgtaaaatcattttacatcatcaatacataagtattaaactcgatatctctctctatatatattttctgttcgagattgattgaaattatcttatttgcttaacatattaaaatgcgtcatttttaatgatattattggtctatagtttttatgtaatacatttaataatgtttagaaatatttgtatataaataacttttatctattatttcaccagagcctatgaaatgtaagcacaggtttgttaatgagtagcacaacatggacagtttgtcaaaggcccaatagcatctttaatgggattcttgaactcaagaactctatccactagatctactattattcttattaagagttttttaagatggagattgggttctaggaaaagaactcctattttttcaaaaatattattttttcttgtgctagtaaaatctaataatccgaattggattctactattagaataaaaaatgatagaagttcgtgcatcctatataacatcatgggactcacaaaaaataatccaagaacctaaaatggattctttgaccaaaaatgttctaagaatctcaatattttcccacttaagaaatataactatcaaatcaatataatatgaaatgagttcaatctttattgattcacttgacgcaagctatatgcacaactgacataatagattttaattctaaataacatgcaataaaaatataacaaacctgttccggaaaaagcctcctcaaaaagaagcacattcggtccccccacaatttttacaagtcggggtctttatgctgcatcaaaatattccatcatatcccgcaaatgtttcgtgctattaagtttatgttagttgtcccttcatgatgcatcaccagcatatcataaacaatcagttaatcccttattctgccgaaatagtcggattatcgtcaatcccccttaaggtggtcgtttgatcccgcttggcaaggcccaactttgaaagtgaattgacctaagcctcttttatgggcttgatgcgtgatagaagatcggaacataatccaatacattccaatctgaaccaaaacaaaacctaaaaccaaactactaactgatctataattttttatacatcataaaactaaaaaaacaaagcaaactaagcacataatcttacaatcccttctgaatttactaaaagagacacagatagttgaggtgggaaatgttgccaaaccagaaatgaattatcacgctccaaattaactttggaagccaacctgcacatacgtgtcttcatgaagagtatgctgaagctggatcctccaatcttgctccagcagtgagctgattaagttgatgagggtagcatacgtgaggatgaaacttgttggttaattacttaatttcttcctaggacgagtctaagaatcagactcaaactaatagaagcctagattcaaggcatgacagagaccataaaagatggcatggagttcagccttgagattggtagacactccacacgatcttgatttcatattttttttcttaaaataactacatacatattaagtagcatggttttaaattatgattgtgattactttaaggtgagtcataaaatctttttatatattgcagctaatcactggaaagtatggctgatgtggttacaattaggagtcttcttaaagcattaatattttttaacttaacaaatataattaaagagaagtaactaataagataatgatctaaaattcttgtattgattggaaatagcgtaaaaagatgtttcaaatataatgatacaaactctttaaatgcaaatggttacatgcacaaagcacgtgtatatatatgtattcatacatacatacatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatttgaatatatctacgtacattcatatatgtatgtatatgcaaacatatatacatctggatagagagaggatcagaatagcaggacaaagacaaacttgtatttgttgcttccatactagaattgcattttcttatatcaactgtgtggaagggaaatttattaacagcgctaagtattctcctaaccttaagcaggatctccttctggtctcttgccatctgagcttgcatgtcaatgatgaaaaacctgacaagcgagtccgcaagtgcctcaagttgttcctggtaaccaagctttgtcacattgaccaaaaaaaccaaggtgacattgaccaaaaaatagtcctgacaagatgttggtaaaaaaatataatcggttaatatcgatcacaaacatcattgactaaggttgacaaaaaaaattttaaccgacattgataaaaaaataacttcgaccaatgtcgatcaaaagaaacataaccgatttcggccaacagaaatattttatatgatagcctttagttgcaaaaagtgtgaaccagggggtattttgacagccgtaaaacatatctcatggcagtggttgttatataaggcaaaaaaccatgaactttcttctcttgctggtgtttggagccacttcaaatgtgattgatgttagagaagttaacagtggcattttttaggactgaaagttaacttaggagaaaccattttttatgtatgtaatacggtaacacatgtacctcttgcacagattggggagaaattgcaactttttttttacattttgccttaaaaaaagtgttcatatttataaaaataattttctatttaacttggatattttttcttatactactacactaaggtatatacaacctaattaaggcgtgtttcttaatttggagactggtgcttgattgattgactaccaacgaaggataatctaaaaaggagaaacaccatttataatcctcatgagtgcttatgtcccttttgccttgaggtagatgagtcggcatctcactgtttcttctcatgtcataaaattcttggtactaatttggaggcaatgttactcttggctgctggctgcatgtaaatgtggtgttgccacaatgaccagaatcacatttttggcaagattctgtattcgtaagttcaaattaagaaggaggcagatgtatggagggcggtgtgggcatcagaaattttggggtgtatggaatgctaggaatgagtgtatgctaaggaattaatggctctttcaatgctgagaaaattacgcagaatatattattctttgcacgatcgtggattaataaaagccagagtccctaattttaattattgttttacttaatgatatatggcacctggagcttgtttcatgaagagacaattttgaatgaaatgtgaagttaatttgattcggtggtagctgctcttcgagtgggatcatcccaaatgcaaccgatgtttatgtgcacgatggtgggggctggttagtgatgcgcatcaatgttgcatggctttagacatgattttaaattgcaattatgattgcgttgcttgcaacgaacctaaaaatcttacattgtggataattatggaaaaatacaaactgatgtgatcataattataattgtgatgtgattacagagtcaaaatacattagcgttatgactgcaattatggttgctgactacaatttaaaaccatgactttgggtgtaatggtccatgttcgatgctagctatctttgtcgagatagaaatataatctaaccatggaatttgctttctttctactgtcactggtgtatatgtttttggatcttaggtacttttggtaccatttaatacaaatcattttgttggaaaaaaaactacggtagcctacatgcaatatacaaaataaaattgaattactatatattatcataaatagtagagtataagaagtaaagaaaattctaaagataaacatgaatttaaaaacatatgaaactaatatatatatatatatatatatatatatataataataataataataagagattgttttaactatatatataacatatttaattagcttaatagaaatgcgaaagtacaataaaaaagcaaaaacataataggcgtgacaaatcggttgctaatatacaataaagacaacaaagtttgaaactaaaaccttatccagactatccaaataaccctaattaatcatgcaaaaattagaacagaagaaatttaataactatagcaacagtaacagcagcagctatagctaatgccgcgatcaccgaatcggaaaacttttcatcattgaagtattctatttcactaaccctaagcaagatctcaagttgatcgcgtgcaataagagctagcatttcaatattgaaaaacctctcaattgagtctgcaagatctttaattttagttatccacggtaagaattattagccacaaaattgtatttccctatttttgaacacttgtaaacaacctctttgctcttcctcaatagttgtatcagtggctcaagttcctgctgtgaacggcccaacatattcctgtacttacctatctcctgccatgtttaccgctacatattttctagaatgttatttgaatttcattaaaaatcataagaagcaagtttgaatttttcagtgaaatttttacttaggtttagttagaaaaccctatttaaaagctatattgttttgcttatcgaaacaaaaccaattagttcggtttgaatttcttagttaataaatcaattttatatgattttttatacaaaatattaaactcaatttactaaataagatttatatcaaattcatgaaggtaaaagtaatatttttatcttttaatgtaaggcttggtttcacttttgtcctttaacttttttttatttgatttatttcagttatcatttaatatttatgggttcttccttaaggaatcttgattttcctatagttttaattgttcttcggttatttattccgaaattgagaggggatcatcacctccaaagatttcctcgctcccattaacaaaaatgtctaaacaattaccttccttctaaaaaatttgtaaagtacctccactaattaaactcaacatattctcccatacttcattttctttgaaaacaatgttgtctaattcaagacgcttcgatataaaatatttagtcgctagaacgagagaaaaaaaattgaataaaaagaagggattttttttttcttcttaacgtacttcatgctacttatttgctggcaatcattattaatatatattatcttatatgagacaattttgaacatttaaatgttaattttgtaagtatcttggtagtatccttttctgataaggaatagatattattttgagattatattatgatgatgaattgtctcataaaaacacgaggcaagcacttgaaaggaacaaattctctaatttcttagtgggtagtgggagagaggaagtaaacttgcttcaataggcaaatgacgcatgacgcactctttataggagaagcaacactttctaaggtgcttaccataaaaagcattttgagaggctttgaacttgtctcgggcctcaaaatgaatttccatcaaagcttttgtggtgccttgggagtggatattgataccttgatgaattatgcaagcttgcttatttacttgagacagactatatatgcacaactgacaaaatagactttaattctaaatagcaataaaaagatatataataaacctgtttgaaaacggaggctacttcaatctagtacggtagttgacttactaagtacgaaacaacaaattaatgagactgctgactactgatttcatagaaagatttaggaagatgaggagtaagaaatgtatggtaaagcttctaggagtagaatatgttactatgtcttaaagtaaaaaaatatttatgtttaaaagatgaattatgattcataattattttaattaaatataaataataaaagttatatataatatattattggatcataatttataattttatgtttgtattttcagtcaatacatttataaaacaatttagcataacatttatgaactaaatttaaaacctttatttaatattttaagattctttcattagaaacaagttccggtataggagttggtatcctttcaaatgatataaagcaatagatttaaattttatattctattttattgtgtcaaaataatgtattaaattctttggtaagagacactataattttaagttattaagttgataattaattaaacatgattttaaatacttacatatttattcacttataactataaagatttagtaagagcataaataaaaaatgttgttataatatataattttaaatttaatataataaaaatgtgttagcaaaatagaaatataaacataaagcgtgacaacacatgtttttagttaataataataataatattaattacaaatattaaataggttttgacaaaatcatacctggcgcaaatatgcagtttagtgacggaattaatttgtgattcatgcaatacaatttgtaccaatcatcatcatcatcataatctctttttcgttttatttatcaatgttgctacttagtacgaaaattatttgcacaaaatacaaacagaatgatgctatctgttatgaaaagtaaatccacacagaattacacgaaacatagaatggacggttatgattttataaaatgaatatcgattaaatttaaatgttatggtaattttaaaatatgaatgataaaatgattcaattattatactttagtttgtaaataaaaattgatttttataatatttaaagtttataaataatattttgaataattttaaaaataaattaattaaattaaatgcaaaaaactgaaattaaatattgcttaaaactaattaattattattatatcatctgctccattataattgttgtgtaaaaaataataattctaaaataatttttatttttattttttaatgtaaaattaattatgtttttttacttatatttcttatatatgaatgatgaactacaaaatttaaaaataaattattgatgatataaagttaattttataaaattattttttatttttttatttatataaaataatgtatgatgataattattttcagaagaaaagcaacacttttctaagataaattgttatagatgtttaatattatattttgcttgtaagacaaaaacatactaactactaaattatctaatttatgtatatttttagtcctttgcataatcgggcgataacttatcatatgaaagaatactgatgatgataaatactttttgaagaataataatttttatgaaatatttgaattagttttacattaagagtttctaatgatcttaaaatgattaaatgtattatattatatttagtaatatacttaaaaatttaaatattgttgtaattttaaaatatgaaaggataaaataattgaattattttacaatggtatttcaaacaaaaataaatagttatactttttttttataatactagtatatgtataaaatagaagaagatagataaataatacaagttatatccaattactacaagtacgcaccgatcaatttcaataaaaaaaaaaaacaaggtgtgagtgaagtcaacaattaagatagaaatgaagttggaagaatcatcgattttaagattgcattatatgctaataattgggctgactatatatacccaacaattaatgttgttatcgttgttgtgcttgtctagtgaatgatggcagatgttgtatttcaaggtatgggaactgcgtggcaatttctgaacgtgattatggtcataaaagacaaagttacgttcaaaacagcattggaaaacctccaatccattctaatacgcagcttgtttctgattgttccaaagtccacagcttaaattttgtggccaggcatcgttacaatgttaaactaaaggcatttacaaagtcatttcggaatatttactccacggtcatgttagctcagattgcaagagatcaaaaagagaaccgtaggagtcaaatactacttgcctacaataatcctgctcagtctcataagattctaagtattgttgatatatattaatattaagggtctatctggataaatgtatttagaagtactactaaaaaaatccatctcaaagcagaaaacgcccttattagcttcacagcaaagacagaaatccacgtcaaaaacattaacaacgtgttttcaattgcctccccagggtcgaagcacgttttctcaacaaccctaagcaatgtctcctctgatctcttgccatctgagcttgcatgtcgatggcaaatagtttcccgagctcgtcgaaaaaccggtccagtttgtccttgtaacaagccctagtcacaaagtgtagccaccggatttttgaacactcgaaaacaagctgtgtcccctcctccatctttctgataaacgattggagttcctccttcggaagctgcaactcgttgtttttctgttctatctccttgatcaccggagatatagctactagagtggatattggaggtgcaccaaagatgatttgaagcaaaccgttttgtttttaagttccaaaacggttcccagcaactcgttgaacacagctcccactgttgcttctattagtagtgccatgatattcacaacagaaacacgcacccacaaggatgaaaacaagatgaagaaataaacctctctttataatatatagagtcaggttaaacgtaatgttaaaaaggaagtttcttggaactccatttctatcctgttgactttacgaacttgtagctaggtatacttgtttgtattatttaccgacttgaacatattttaattatttatttaattaactgaatagttataatttccttaatagatgcgagatgccaaatcttgttccaccctccaaccccaaggataattaatagttaagtgtgaaatagtatgtgtgtgtctatctatatatatattataaaattttttatacaattatctaattataacatattatttatgtgagaaatttattaattttttaaataattcaaatgataatttataatcagatgaccgtgtcaaattattttataccatcaatgaataaacattaatctctctctctctctctctctctctatatatatatataaattctaatcaaggttggttgaaattatcttacactaaaactaccattattcttattcaagagtatttcatgatgaaggttggattttaggagaaaaattcctaaaaattcctttttttttttgtgcaagtaaaatctaagaattcaaattgaattttatcattggagcaaaaaatgatagaagttgttgcattctatatagcatcatatgacccataaaaaataatccaagaatccaaaaaggattctttaaccaaagatgctctaagaatctcaatattttctcacttaagaaacataactatcaaattaatatactatgaaacgagtttaatctttagtgatttacttgagacaaactatatgcactactggcataatagactttaattctaaagaacaatacaaagacaacaaacatgttccggaaaaaagcttcctcaaaatggaggctacttcaatttagaacactcacgtgaagtgtattgtataacatgtctccttaggtcagaatgagagctttttattcgtgcttgaagcacgcccccttcaatttttacaagtcgaggtctttatgttgtatcaaaatgttcaatcatatccagctaatgttgtcgtgcaattaactttatgatagttgtcccttcatgatgactaactgtcgtaccataaacaattcattaatcccttacttttgctagcgagaaaattgttgctgcagtccactgtaatatcatttgttgcaaaaaattttgcaacgatatttaatgtcactaccactcttaacgctttcgcaacaaaaacttctactatttgataactacgaaaattaggcttaattgatagtcaaatttaactaaaaatgattagaatttctttattttattattatttttaatagaataatgaggattttaatatcattttaattcttctttcaagtttttaatttctcctcctcagtaatctagattccataagatacttcttgaagtgcagctatgatttttttttttttgtattttaccattcttttcttaaaattatcatacataattatatatgctatatacttgttgttagggaagaagataaaagttggttttcgaggatcagggcctccactgagaaaaggataagggaaggaacagttgtatattccattgattgatgctgttattacataatattatttatactgatttctcaataatcaaatttgtctttttgtgctacagaatatcagcaaatggttaagtttgtctacccctacagtacagtggcggattcaagatcctaagtcagttggtacaaattataaaaaataaaatcagtgggttcaattatataaatatagatgaaataaaatataaaaatataagattttatttacaaatttggtgaattttaaaaaatgaggggatgcaagtgcacaccctcagatggctgtaggtccgtcattgcttccagatatggtgcacctgcttgcaatccttgagctaagtgggccttgtaattgctctcttggtcttgttttctaattgcacccttttctgttgcttgcttgctgcattctcatcctctgtttctgcaactggttcctttgctacgctatcacttgtggtgccgtttttggcttttccagtcttcccaagttcccactgattcaaattccaaaagttctgcaaataaaattgaagaagaagctagaggtgggaaatacttaagtcattctcttgaaaaagttgcagcaatgatatgcaacaaaatatcactataccgagtcaaggtaattattgtgttcacatgaacatttctcccatgaaaatatatattttctgactttgtaatctctttatagtatgcatggaaaaataattttctgattttttttctctgtagtgttatatattatttttaatcacattttcttatttatttagtttgtttctgatttgacatcatgtgaatttggagatttgggttagaaatatttttggaattttcctggttagaacttgataggtccataatgaaggtatataaaaggatagggaaaagagggagagcggaatagaaaaagaaaggacaaatgggcctcaaaaacaagacatgcttgtgtatgacagcagaaagaatcagcagtacaagttgcactagctgaagtggaaaaggaacataggttgacataatggaatggatagcttgtaaggagagtgtacgtagaggctgagaataagttcttccttaagaaagggagtgggtctgggtttgttttttcctaattaccattctcaacatctggcttgtatccgccactccccttctctctgagttctatttttcatacttggaagcctattttttttaatataaatataaaattatggggatatctacctgtcaaaacttaatataatatattagtatctattatttatttattttattgattttatttagtaaaaatcacccacttttctttccgcatacatctttgacatatatgtaaggacattgaaatctttaattcattaatatatgtttttaggaataaattaacatgtgttctttctttaattctatgcgtatgggttaaccaatattcaaactctagaccatttagttaaaaaatacaagtcattactatttgtgtcaatcattattggtacactgcacaagtttaaaatctagttagatttgtaaagaaatgttatgttacatttcaaatgacttctgactttctttagtagctaaaaaacttgtttaactatttgataaacaagttttttcaataatttttaacattttttaaaacgttacttaaattaatatttttaaaaatactagtttctaacattttatatttttttcttattttatctttaatatataaacttaaatcttgaattagttagatacaagactatatccaatcccacttaactaacctcaagaaattagatgtcttatataattattaaatttatttaatacacgtctttcattttgtaatgataaaagatttactgataataatgcattccttttatagtattaattattttatttctattatgacattattttcttactctaatttttaaatatttttacttcataataaatataagaaatgtaatatcaaatattatattaaaattaaaataattttaatacgaataaaacaattaatcatatttctaatttatgcgttatgtttttaagctgaaaaataaaattaactgtaaagatttgggtttagttaaatttattcgtaattgactttagaaggagtaaattgaaatacacttttaaattaatatttgagtttctctatcaaaaaaggctatttgagttttatatttttattccgacgtcaaattctttgatatgtatagactatatttgagatacttttcgctttgaatttctatcacgctctgagaaatcaaatatatatatatttctcttgatcttaactttaaagtttaaagtgatatgagatttttacacatactaaaacaattttttctcaaatatgcatccattgatatccttgtctttgggtttggatccaagagtttcgacagcaatctgcgtacatctggtgcaatccagttaggaaatttgaactctcccctgccaatagaacatacaagatcataactccttctgtttatcacttccggagcagcataggcaggggcaccacatgtagtgtggagtaatccatttatattcccattttcatccagtagaagattttctggtttcagatcacgatggcacacacctcggctatggcagtagtcaacagcgctgatcaattgctgaaattatctcctagcatcatcctgcttgagctttcctttggataccttattgaagagctcaccaccttttacatactccataacaaagtaaattttggttttgctggccattacctcgtaaagctcaaccacatgtggatgcctggttagcctcatcgctgaaatttcgcgcttaatctgatcaatcatcccaactttcagaatcttctccttgtcagtaatcttaatggccacactcatgccagttatgatgttcctagcatggtagacttttgcaaaggttgaacaaggatagctcagatggaggcacggactcatcaacctcggtgaaggaattcttaactgtcaagcacatctttcaccattccctgattttggtgatgacactagagaacaatgaagaatatggacttcttggaaagtttgaagaataattaaggaatgatgcagcacctggttagccttccaattacccagcagcagaatatacaatgaaagacacacctgaaagaaagatgaacaaatttaataagttgggatcattgtcagagaatataatctcctgaataaaattcttgaaacttctacaaacataaccagcataacaatttttataacttgtttctgatgtcatttttgaacaatcccaaaaccataaggcattaggtgagttttgatcatatttaaacaggactggattaaaaaacaaagtatttagcacatcaattacatttctctcaggtagtctagtcgtttttagagttcttataaataaacgattcatgaccaagaagaacaacacaagactaaacaagtatgacagaaatgtaagattgtcaaaaatcaagaataaatcgaaaccagagatggccacacattatgcagaagaaataaaatttaatcaaacaatcaatcagcagatggcagaaagcacactaatacaacaaaatacatcaataatgaacttgagattcataaaaaaggagcatgcaaacaagtgagacctgcattctgttttgaattacatagacaaatcaagtcattcacactcatctgcccaaattaatcgtctaaagttgggagagtttaatgacactcgagaagaaaatgaaaattcagtaaggtttcaaataagcaagtataaatataactgagttgccaccgttttcagatgaatgtggttccactttccattacaatcgttaccgtttggcagtctatctaccaattttcatgcttgggtcacatgcactaagttattgtcaatacatattggcaacaaattaaaattttccagatgaaaaaaaaaggaaaaaatttacaaatttgccgataagagaaaaaggcaaataaacacaaacacccctctcaccaagagagagcttaactcatgaaaataacaaccatccacctataccagaatttggttttaaaatatcataattttgtactgtttatttttaaacatgttattatttgtaaaaattgaccaaaggtgcacttagatcttctcatgctacacaaaaatcaagtttaataaacattaagaaatatttgttacatttaataagggagattttcataataaaaaaaattctgaatttcaataaaaatacatttgatgatctattttttgtagtataaaatctttgtataacattagaaattatgaaatgtaaagtcataaaaaggaatattgatatactctatattgtttctaagttttttactatccactttgtagtagtattgaataagtaaaattctatcaaaatctttcacacaaataaaatcaggtgaaatctcaatattatgattgggcaagatttccctcatgaatgatagaatctgaattttatttgattcttgcttgctggttgattttttcttaagaatttaacaaatatatcttttatatatatatatatatatatatatatatatatatatatatatatatatatatatatatatatatatgcatatatatacttatattagatacattaaatttcaaatttctgtaacaacctttgtgaattataaggaaagtctggtcaactaaataagctaatttacactcatgcatacaatcgcttcacttgaacttaactcaatcgtcatcatcattattatagtgagttaatagaaatgcaagattctcattactaaaaaaaaatagtcattactaaaaaaaatagtcattccataaaaaaatagctataagaggtcttgttaataaatattcttaaatactaagaaaacttaaaaatattaaataaaaatataatattagtatattaaaattgtttgaaatttaatttattattcaaacaatttgcttttttaaaaatcttaacaatttcacttgttacaatgtgacaaaacattcaaggaagaaaaaacaaagttaacttatatgtggggagtgagaaatacgacaacaaatgacgctataaaagtaatatattgttgataaatagaaaaaataagtcctctaataaaattggtaaaacaaaattaaaacttcattcaataatattttatcatctataataattatgataattactcttaaaatcatctctacgatgatctctgagggaatgaaaatataaaataaatttcc

SEQ ID NO: 177 - DNA, 907 bp, Glycine max
  misc_feature (14)..(14): n is a, c, g, or t
  misc_feature (21)..(21): n is a, c, g, or t
  misc_feature (23)..(23): n is a, c, g, or t
  misc_feature (35)..(35): n is a, c, g, or t
  misc_feature (46)..(46): n is a, c, g, or t
gaccgctgggatangatccgncnctcgtgtgaatncaaaatccgtncccggggatcaggcaaaagttccaaaaaatcacaggtctgcttttctcaaagaaatcggaggaaagcgagaaaagagaaaaatgatatgaataccgaagaactcactaacgattgttgctttttctcaaatagtgattatgtctttggcaactgttcttgcggccatgtcctccctttggagtctaattttgatcttcgaacgtttaagttttcgacatagggttgggtggagcttgttcgcacgatgaagcaaaatgggaaagcttttgtttcgattgtgggaacactggtaagcgaaatgaactggttttgaaaaggggaaaataatggcacttaattagggattggaagtggaaagaataaaacttgatagagaagcaccatatccactaaaaaaggggtctcgatgttgtaagaagtcggtgggtctttctacaagtccttgagctccttgaggatgcgctttgaagccatgggagggacgattcgcattcagatctggatatcatgtcttggttgtgcagccccgattaccgcagtccccgaaagatggatctgaaagggaaagagggacatagcgcgagcgagaggtctctgtggcctctccctgctggttatcgaaatacccattgatggacaacaaatgctttgactctccccgagggcgcttttttcctaaaaagcttttcctctccgaagaccgctttttcactacggtttccgcccaaccccccggggaatggccactccccaacatcccacgtttcccataattgcccctggccgttcccacctacaatgggccccctttgcggaaccggcctcgtttttcacaaacttaaaaaacggcctttaccctc

SEQ ID NO: 178 - DNA, 734 bp, Glycine max
tgacaatagcccaaacacaaacacacactaggaatgagttatcacattcatatataataaaatattagagcatgtaaaacatataatacttaaagctgaatttatataattaacatcacttcccaaaatcacacacattttgcacatccattcaagttcatccactccagaaaataacatcaaaccacaattgttaactcaatgaaagtcaaacacatgcattatgcaacaaatactctagacttaagcctacatgcaatgtggtaccatttttcagtgaaaaacctcgttgggcgcctaagagtacatgacaggacatgcctcacaatgggtaagttaggtcactttcactaagtgaaatcatagggagaccagtcaggatcacgttgttttgcgagaatgctccaaccatgtgggagcggcacaggcttaaaggagcactcaaatcggatgacccccaaggcctacactccgaagagttcgtcagggcctctccctcctgattcaggtctaacccaaaaaaaaatttgaacacatagactctacctatgaattatgcaatgcacacaactactcaattgtgtgtgtgtgtatatatatatatatatatatatatatatatatatatatatatatatatatatatatgtatgtatgtatatttttaaaatatattttaactcagtgcacctcaaggtattaaactcgtcgggttcccgcagtggatcctcaag

SEQ ID NO: 179 - DNA, 19057 bp, Glycine max
accacttaagtaaaaaagaatcacttgataagaaagaactacgtaggtctgattttctcatcccaaattgaggaatacgtaggagcaaagggaaacacccttgtcgaccacaaaaaaggaaaaaatataaaaagggtataaaggatataagaacataaaagggaataaaaaaatcaaagtcatgtttgcacattcgattaaaggctgccgtcccttgggacgggcgtgtggggtgctaataccttccccgtgcgtaaatacaactcccgaacctttcaaacttaaaaattcgtagatcgcgtcttttccggtttttccgacgttttcctcaaataaacgttggtggcgactccgcacgtattcctttcgtggaacacgcatcccgcgagtcacgcgtcgccctcccgccgaagggtaggttgcgacagttggcgactccactggggacctgttttagagagttaggccatttaatcttgtgcaatgttttatcatgactttctcctttgttggtttccctttatttgtcttatgttcttgtgtatataaactatttgttgcttttagtgtattttaaaatgtatgcatgaggtaaatatttattcatttgatgcacacaaacaccaacactatttgcacacactgtgagtgaaaaaaaaagggccctatacccgggttcgtgggaacataaggagtggaggtgaatctgtgatcatgctaggtctccgacttgcttgattacagtgaaccctcatctagagcttttctctttgaaaacctattgttgctagtagtccctactgctacgatatgttcttcaaaggggatgatacctctagaaaccatcaagagagatataactaccttggggattattgctaaaagcctagttagttctctcccttataggtcctttaaataggggcacgaagcaaacacgctgcgtgccatttttcacactgccatgcatgagtatcatatacccttttgcttatgttcagtaaatattgtcatactgtgtacgttcccgcattgtgtcttttgcataagcattgcatacggattctttcttgatccctactgtaaacaaaccaacggagggtccgtgtcgccttcttaaaaacgtgcgttggcggcattttgctacccctagacgtcgtatctaagaaggggacaaattccccggacccccgcattcctagattgcatctgtgtcatatgcactccatcatgcattcatccattccacccatgagatatcggagttttgatttgcaccagcttttatctcactttagtaagcatgggaacaaatcaaaccggcaagaggttttaccaagtcaaggtcaaaagcccagataccaccagcatcaaggaattagggcggttgatggaacccctccaaatgcaagccttccgcaagacttacggaaagatcttagagttgaccatagcagaggtgtccatagaagccattgcatcacttacccaatactacgaccagcccttgagatgcttcacattcggggacttccaattagtaccaaccattgaagaatttgaggaaattctaggatgtcctctcgggggaaggaaaccatatcttccctccgggtgtctcccctctttgagcagaattgcaactgtggtcaaggattcagccagaggtttggaccgcataaaacagactcggaacggcatagcgggcctgccacagaagtacctagaagacaaggcgaggggtatggccaatcaaggagactgggtcccgtttatggatgtgttagctttgctaatttttggggtcaccctctttccaaacgtggatggtttgatagacctagcagcaatcgacgctttccttgcctaccaccatagcaaggaaagtccggtggtagccgtcttggcagatctatttgacacatttgaccgaaggtgcgaaaagagtagcgcacggatcatctgttgcttacccgccctctgtgtttggttggtttcacacttgttccaacaagacacaagacatccatgtccgctcctgagccatcgctcatgtactgaaaagaggagaatagattgggaccagctcttggccgggataggaggtagaacaatcagttggttcccccgatggaaggaaggaaaagaaggagtcctttcctcgtgtggaagatacccaaacattccgctggtagggacgaggggttgtattaattacaatcccacgctcgctataagacaactagggtaccccatgaggggagcaccgacggaagaaagcatgtctcctttccttgtgagggatctcggcgcacaaaattccaagactatacaaagaatccataaagcatgggaaaccccgttaaggaaagatcaagagcttagaggcattcgtaatggcatcattggtgggtaccaccaatggctgaaagttcgcatacgaggtttagattggctcgccaagttaaaagtcgtcagcgaagagaattttgaagcaccggaagcggatgaagaagtccaagctctcaaaagcgagttaggaaaggcaaaactcgccaaggagaagttcaagttggctgctacacacgttcggaaggagtgtgccgggttacgggaagagaatgcaattaccgcaagggcccttgaacaagagaccaagagggctcgcagggaagagtatggccggaacaaatttcgcggagctctatggggtagcaataatgaactcaagttgcgaagggaagaaagggaccagtcgcgagcacatagcatggttctgaaagaggagttgattacttgttcaaggtccaaaagaagcttgtctcagcgtctatgcgagacagaaaccaacatgttagctatcatcgccaagtaccaagaagagttgggtctagccacggcccacgagcatagaatcgcggatgagtatgcccaagtatatgcggaaaaagaggctagaggaagggtgatcgactctttacaccaagaggcaaccatgtggatggatcagtttgctcttaccttgaacgggagtcaagaacttccccgattgttagccaaggccaaggcgatggcagacacctactccgcccccgaagagattcatgggcttctcggctattgtcagcatatgatagacttaatggcccacataattaggaatcgttaaagaaacttgtatggtctctcagaccttgactagatatgatttctttttttataaaatgagttggtcccatgtttctactccaaaaagcttgtgcaaatcaaatcactcctacatctcatctctagcatgcattttctttctttacccactcctcacgtttggttttttagggaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaggtatgaaacagctcatggagaagaacgcggccactgccgccgctgtcagttcggctgccgaagcagacccgactcccttggcaactacgcaccatcctccctcaaacatagtaggacggggaagggacacactgggacacgatggcagccctcacctgggatacaaccgagcggcttacccttatggattgccgcccaactattcaccacccgtcttgcaagaagatgcgggccacattgcttctcccgtccatgaaagagagcctcctcagcagcccgacgaagtccacaaagaccctcaagattacgctcgaagggatgtcgagttctatcccccgatccccgaagggccggcaccaggcacattgcctcaacccaacatcgcagcaccgccaatagttttgtctatggaagggccgcccccggcaactgaagaaaggaggaagctcgatctccttgaggaaagattgagggctgtggaaggatttggggactatccgtttgcagacatgacggatctttgcttagtacccgatgttgttattcccccgaagttcaaagtgccggacttcgacaagtataaagggacgacttgtcccaaaaaccacctcaagatgtactgccgtaagatgggcgcccattctaaagatgaaaagctgttgatacacttctttcaggatagcttggccggagctgcggtagtgtggtacactaatttggaagcttcccgtatccgtacttggaaggatctgattaccgccttcctaaggcagtatcagtacaattctgatatggctccagaccgtactcaactgcagaatatgttcaagaaagagggtgaaacctttaaagaatatgcgcagcgatggagggatttggcggcacaagtagctcctcccatggttgagagagagatgattaccatgatggtagacactctgccagtgttctactatgagaagctagtgggttacatgccgtccagctttgcggatctggtgtttgccggggaaagaatcgaggtgggattgaagagaggaaagtttgattacgtttcctccacaaacgtgaacgccaaaagaatcggggcaacaggggcaaaaaggaaggaaggagatgcccatgccgtctcttcaacgcccgcatgggtcaaaccccagcaaacacctcatggtacccatcagtacgcgcaacatcacccaagcttctcggctcctgctgggaacgcctctagctcaacacccgtacagcctaaggcacccacccagagggaagctccccaagttccaactccgaacgcgactcgaccagccggtaattccaacacgacaaggaacggccctccgaggccgttgccggaattcaccccgctcccaatgacgtacgaagatcttctaccatccctcatcgccaatcatttggccgtggtaactcccggaagggtcttcgaaccccctttcccgaggtggtatgaccctaatgcaacttgcaagtaccatgggggcgccccggggcattccatcgaaaaatgcttggcccttaaatacaaggtccaacatctaatggatgccggatggctgactttccaagaggatcggcccaatgtgaggaccaacccgctcgccaatcatggagggggggcagttaatgcagttgaatccgataggccccacaggtctaaaccgttgagagatgtggcaacccctaggaggtttatctttgaggccctacagaagggaggtgtaattccccatagtgggtgtaaggaggattcctgtctgctacatcccggcgagatgcatgacatggagacgtgtttggaagtagaggaattgttacaatggatgatagaccaaggtcgactagaagtcggcattaaaggaaaagaagagccgcatatatgcatgcaatctacggaggggagcggtattgcgaagcccaaacccttggtgatatactttactaaaagtgcagcctcgcaaaagcctgggcatcccttaatggtcaaacctgttcctttcccgtaccagaatagtcacgcggtcccgtggagatatacacctccggagaagaaggaagaagaggtcacagacatcagctcgctgtcggctaaagtaacaaatatcacgggactgagtggtgtgacccgtagtggtcgtgtgttcgcacctccggacctaccggtccaacccgccgacgtcaagggaaaaggaaaggtggtggaggaacaagatggcgaagcaccccacgcttcgaataaagatattccagcaaaggggcccccagagaaaagggatggtagaaaggaggtgtcgctagaggaagccagcgagttccttcggataattcagcagagcgaattcaaggttatcgaacagctcaacaaaaccccggctagggtctcgctgctagagttacttatgagctccgagcctcatcgggctctgctagtaaaagtgctgaacgaggctcacgtggcccaagatatttcggtagaaggtttcggagggctggtcaacaatatcactgccaacaactatcttgccttcgccgaagaagaaatccccgccgaggggagagggcataataaggctttacacgtatcagtcaagtgtatggaccatatcgtggccaaggtacttatcgataatggttccagtttaaacgtgatgcctaagagcactttggacaagttaccattcaatgcttcccatttaaaaccaagttcaatggtggttcgggccttcgacggcactcgccgagaggttaggggagagatcgatctcccagtacaaataggccctcacacctgtcaagtcaccttccaaataatggacattaacccaccctacagttgcctgttggggcgcccgtggatccattcagtgggtgttgtgccttctacactccaccaaaagctgaaattcgtagtggaggggcacttggtcatcgtgtcaggcgaggaagatatcttggtaagctgcccatcctccatgccttatgtggaagccgcagaagaatcgttagaaaccgctttccagtcttttgaggtggtcagcatttcctccgtggactccctctttgggcaaccttgtctgtccgatgcggcggtaatgatggcccgagttatgttggggaacggttatgaacccgggatgggtttaggcaaagacaatggcggcataactagcctgataaaaacccaaggaaatcgtgggaagtatggtttaggctataagcccactcaggcagacgtgaaaagaagcatcgcgggaaggaagaacagtggtcagagctcgcgttggagacaagaaagtgaaggaagcccgccctgccacataagtagaagttttataaatgcgggtctgggagacgaaggtcaagtggtcgcgatatgtgaagatgatgttccaagaactctggatttggtccgaccatgccctcctgatttccagctgggaaattggcgggtggaggaacgccccggcatttacacaacaagcataatgtaaacctttacgtttttaaaagctctatagttgggcctaggctttagagttttcattttgttaaggctttgtgtcttttgtctttgaatttataatacaaagatctttcttcatctgttcctggtctctacccattctcattcatttgcatgtttacttctttttctgaaacggcagatccgatgacgagtcccccgaaggtactaatacctgggacccgtctatcaatttcgagcaagaaatgaaccaaacggaagatgaaggagatgagggggtgggacttccttcggaactagaaaggatggttgcccatgaggaccaagaaatggggcctcatcaagaagaaacagagctagtagacttgggaattggcagtggaaagagggaagtaaagataggtgcaggcattaccgcacctatccgtgaagaattaataaccctgctaaaagactaccaagacatctttgcttggtcataccaagatatgcccggtttgagttctgacattgtgcagcaccgattgcctctgaatcccgggtgttccccagtaaaacagaaattgaggaggatgaaacccaaaacgtccttgaagataaaagaagaagtgaagaagcagtttgacgctggatttctggccgtcgctcggtatccagaatgggttgccaacatcgtaccagttcctaaaaagggtgggaaagtacgaatgtgtgtagattaccgggacctgaatcgggccagtcccaaggacaattttccgctaccacacatcgatatcctcgtagataacacggccaattttgctttattttccttcatggatggtttctctggttacaatcagataaagatggcacccgaggatatggaaaagactactttcgtcaccctgtggggaacgttctgttacaaggtgatgtcctttggactcaagaatgccggggcaacttatcagcgggccatggtagctttgttccatgatatgatgcatcaagagatcgaggtctacgtggacgacataattgctaaatctaaatctgaggaagaacaccttgtcaacctgcggaagttgtttgaaaggcttaagaaatatcaattaaggttgaaccccgctaagtgcacctttggggtcaaatcagggaaattgcttggtttcgttgtaagccagaaagggatagaggtagaccccgaaaaagtgaaggctatccttgagatgccggaaccccgtacagagaggcaagtccgaggtttcctggggcgcttgaattatattgccagattcatatcgcagctcacagccatttgtgagccgttgtttaaactcttgcgcaaaaaccaaactgatcggtggaatgaggattgccaagaggcttttggaaagatcaaaaagtgcctaatgaatcctcctgtgcttatgccaccagtacctggaaggcctctcattttgtacatgacaatcttggacgagtcaatggggtgtatgctggggcagcatgacgaatccgggaagaaagagcgcgctgtttactacctaagtaagaagttcacgacctgtgagatgaattactccttgctcgaaagaacgtgttgtgctttagtatgggcgtcccatcgcctaaggcagtacatgctgagccatactacctggttgatatccaaaatggacccggttaagtacatctttgaaaagccagctctcacaggacgaatcgcccagtggcaagtcctgctatctgagtttgatatagtctacgtcacccaaaaggcgataaaaggaagcgctttggcagattatttggctcaacagcctcttaacgactaccagcccatgcatccggaattcccggatgaggacatcatggccttgttcgaggaaaagttggacgaagatcgggacaaatggactgtatggtttgacggagcgtcaaacattctaggtcatggcgttggggcagtgttgatctctccggacaatcaatgtgtacctttcacagccaggctaggattcgactgcaccaacaacatggccgaatatgaagcatgtgccctagccgtccaggcagcaattgactccaatgccaaactactcaaggtgtacggcgactcagcgttggtaatccatcagctgagaggggaatgggaaactagagatcccaagctgataccctacaaagcctacatcaaggaattggctaagactttcgatgagatctccttccatcatgttccccgcgaggaaaatcaaatggcggatgcacttgctacattggcatctatgttccagctaacaccgcacggggacctaccctacattgaatttcagtgtcgtggcaaacccgcacattgttgccaagtggaagaggaacgggacggaaagccctggtattacgacatcaagcgatatgtcgaaagcaaagaatacccgccggagattgccgacaacgataaaaggacattgaggaggttggcagtcagtttcttcatgagcggaggcacactgtataagagaaatcacgacatgacactcctgcgatgtgtggatgccaaggaggcaaatcacatgatcgaggaagtccatgagggctcgtttggaacacacgccaacgggcatgctatggccaggaagatcttaagagcaggttattactggcttaccatggaaagtgattgttgtgtccatgtgaggaagtgccacaaatgtcaagcgttcgcagataatgtcaatgccccaccacatcctctgaatgtcatgtccgccccttggcctttctccatgtggggaatagatgtcatcggggccattgagcccaaggcctcgaatggtcatcgcttcatcctcgtagcgatagattatttcaccaagtgggtcgaggcggcttcatataccaatgtcacgaggaatgtggtggtcaggttcattaagaaagagatcatctgccgatatggtttgccaaggaagattatcacggacaatggcaccaacctgaataataagatgatggcagaaatgtgcgaggagtttaaaatccagcatcacaattccacgccctaccggccaaagatgaatggagccgtggaagcagccaataagaatatcaaaaagattatccaaaagatgaccgtgtcatacaaggattggcacgagatgctcccattcgcgttacacggttaccggacttcagtgcgaacgtcaactggggcaacgccattctcattggtatatgggatggaggcggtgttaccgtttgaggtagaagtcccgtcattaaggattttggcagaatccgggttaaaggaatcagagtgggctcaaacacgctacgatcagctcaacctcattgagggtaagcgcttaacggccatgagtcatgggcgcttataccagcaaagaatgaagagtgcattcgacaagaaagtacgcttacgcaagttccatgagggagaccttgtgctaaagaaaatgtcccatgctgtcaaggaccatcgagggaaatgggccccgaactacgaagggccttttgtcgtgaagagggctttttccggaggagctctggtgcttaccaacatggatggcgaagagctaccttcacccgtgaactctgatgtcgtcaaacaatattatgcttagaagctggggcaattaaggatgtcgctgcatgttctgtatctttatgcgttttctggatttcccccagggatttcctgtctgttgtatctctcgttacaatctttcaaagaaatgaacgtggattcgaggcttttagtcctcacgttagtttcacatcttgcgttaatttgtgatcacctgagcccttccgctcagttcatgggatcccccaagcgcttaattagaattgaacctgaaccaactttccctaaattttctgcgtttgaaaacattcatgcatacgcatacgcatacgcatgtatattgttgtggtaaaacaggggcaggatcaccttgggctactttctggagtgaggacaaaacaggaatggcagaaaccagtcaaggtagggtaatgatgcggccaaaattggccatacctggttgtttattacttgcaggtacttaaggatgaacgcaagcggggatggggtcacgaccgaccgatcgttgcccttctctgtgcgaaacaagcagggaatgtcgctgcaaggcagccccgtatcctttctattttgtagctttcttttactatttgtttgttttaaaaaaaggaaaagagtaataataagataagtaatcaacgcctgattctaacctaagtaagttcaagttaggcaaaaggctaatccatgagaagggaggggacatggtcaatgttcccctcaaaaaaaaaaaaaaaaaaaaaaaaagtgcaggttagctcgcctgggcgagctgggctcgcctgggcgagccacctctgcaccaaaatataaaaatgacgaagggggggatgttttttttcattcaaaaacttccccccctcattcaaaaaaagaaagctcacgggactcacggattttgcagcccttaggtcaccattttttgcgtttttgattccgttttgctctattattcgtctccaacaagtaagtacctcattcttgggctttctagctttccattgatgtattttggtgctctaaattgcatgtgtttgctaagaaacgtgagggatttatcctcaaattgttgcttgtttttgttgaattgaggggttgtaagggatggccttggcctagggtgtattctgaagtaatggcgcatgccacattgtccccattctcttgatattcgtgcctaaacatgcgcccaccaagtgctcggtgaaatgcctcaacgacatatgagcatggttttgtgagctttgggttgtgggactgttttatatgtatagggacagcatgaaggatttaaaatgaatgcccgaatgcaattctaggcctaggaacccaagcttttaatttcaatacaaggaagcatgacttacgcctaggaatctaagttttggttttgaatgtaaaaaggcatgaatattaggacatgtttgagaggttgttattagaatttaaatttggctgccccatgaggaataccttgcacctaggtagcatggaaaatacctttcaacggtatgtatatatgtgaatatatatagcatggaaatgccttgcaaaatatgaatatatatagtatgaaaatgccttgcataatatgaatatatatagtatgaaaatgccttgcataatatgaatatatatagcatgaagtgccttgcaaagtgttggatgggtagcgtaaaagtgtttttcaaaatatatgtatttgtgagtaggtaataaaagaaaccttccaaaaaatgtatatatatataggatgtagcatgaaaaggtttgtcaaaaaatatgtacatggataggtgtcgcaaaatgcttcacacaaaattttttatgtgtgcaaatacgtatgtgtcataaaatagcacgaccccaatatgattattttataaagtgcatgttgacactcgggccatgagaagtgttgtttggcccttgtttgtaatgattgttatatttcttgtaaactaactttccaaatgtttgccttcgcaggaatggccccgaggaagcttgcctcaaagaggtccaggaaggacaaggcggccgaaggaactagttccgccccggagtacgacagtcaccgctttaggagcgttgtacaccagcagcgctttgaagccatcaagggatggtcgtttctccgggagcgacgcgtccagctcagggacgacgagtatactgattttcaggaggaaatagggcgccggcggtgggcaccactggttactcctatggccaagtttgatccagaaatagtccttgaattttatgccaatgcttggccaacagaggagggcgtgcgtgacatgaggtcctgggttaggggtcaatggatcccgttcgatgccgacgctatcagccagctcctgggatatccgatggtgttggaagagggccaggaatgcgagtatggccagaggaggaaccggtctgatgggttcgatgaggaggccatcgcccagctgctatgtataccggggcaggattttgcccggaccgctgcagggaggcgagtgcgagtcatgcgcaccaacatgaccaccctgacccagatatggatgacgttgctcctcagcaacatcctgcccaccgatcataattccgacctccccatgcctaagtgccagctggtgtacgccatcctgacacggatgagcatccatgtggctcagttgatcgctgatgccatctatatttttgcaggtatggcgcccactaggcaccctttggacccagataagtccaacagggctctgggattccccgcactgatcacaggactctgccagtcgttcggagtccccgttgcacctaccaaggtgattcggccgcccatcacccgggcttttattgagaagtactgtacccagagacaggctcagggtgatgctccacaggccgcaggcgtgccaccaccacctcatcaggctggccaggctggggcatttgacatagagcagtatttacggcatttggttcgccagcaggcggccaaccaccgagcacatgtacggacccatgattgtctgtaccagatgagccttagcatgcagagccagggcttcgctcctttttcatgccctactccagaccagttcagggcagaagttgcatggcccggagattggcccgaggcccaagcaggagaggcacccccagaagctcccggcgatggagaagaagcccacgaggatgaggaaatggctgatttgcttgacttcttgggagggagtggagacacgtgactgggagatccccagattcatgttttctttcatatttcttttgtcatttttttgttctatgttattgttttgacttgagagactaacgtttgtttttgttgtttcgattgtcattttgtacagtgcatacatttttgtttagattggtgcgttagtatttatatatcattactatcgatgatgtttgaaattctggaaccgtgtagagttcttcgtttaggaacatcgtccaaagtatatatgtaaaataaacaaaaaaatcatgataaaagtaaaaaatagagaaggaaagaaaatgaaatagaaaaggaaagaaaatgaaatagaaaagaaaagaaagtgataaggaaaaagagaaggcaagagaaaataagttgtctagctaaaaaaccaacatgcttttgaaaagagacgatttccaacttttctttgaaaaaagttcattgatcataaccaattcttggaaaatgtgtctacacctgaagggtgaatgctgtgaaatttccccggatgcccgaaatggactcggatgaatgcacaaattgataaaagaacatattttggaaacattgggtcgattaaaatagagggaatgaatcctgagccctagcatcacatgaccataaaagtttgacacttgagtgtccgcgtagatgcatgcatgaccagttttgcataaagtttccaaatcatcattttcgcatttgtgtcatggaaataatgtggggcatcccttttatccttgaaccaaaccaaaccctgacatgtatcatgtctagccattctacaaaccttgattcaaaatcatgactcactataatccttaccctcggaagcaaaaaaaggaaagaaggaaattttccaatcaaagagaaagcaaaaagaaaagaaaggaaattcccaatcaaagagcgggagaaagcaaaaagaaaagaaaggaaattcccaatcaaagagtgggggaaagcaaaaagaaaagaaagaaaattcccaaccaaagaatgggagaaagtaaaaaggaaggaaagaaagttcttgatcaaagaaactagaagaaatgtgcagaaaggtcttttgaccagacaatatctgaacaatacagaattgtcaccaaatgaacaaaaaagaaggaaaggaaaccacgacctaaaatggtcttctccctttgtttaccaaccaaaatcccgtgcgctagcgaccttttttctcgccccgcactaaacaaaaaaaaacagacagaaaaaggaaaagctagaaaaatcaaaagccaaaaacacacaaaagccgaaagaagaaaccaccaaaagaacccattcccaagggaagccctattgatccatgatcacgcgtgtaatttttgatttgataggaaataatttgtaaagtcaagtcatgacatatctatggttcggaattaggatgaaacacttacctgtgcgagattgatacactttgagtagatttcttctatttttgtcgaacccagtgtttcctctaaatggtcatttagaaacgaaatgctaacatccaagatctcatttatggttatggggggatcccatcagcagactctccttccctggtaggcgcattgtttgtcactcaaaaaaaaagcatatgctgctctaaatcagttggaatatttgtctctttgctaaagcatgtttgcattttagtggagaaaacaacgaaactttttcaagcctcacaagttatccagaactacgtaggtctgagttcctcattggaggatacgtaggagcaagagcctcgcttttgtcgaccacaccgccttttgttgccataactcaagagctggtagtacgcggagataccttacgcttatccgcaccccttttgccattcagacacagtcgtgtccgttggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgcaccccttttgccattcagacacagtcgtgtccgttggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgccccccctttgccattcagacacagtcgtgtccgttggcaagcagagaccaagtttggtcattctgcacacatgatacgcggagataccttacggttatccgccccccttttgccattcagacacagtcgtgtccgttggcgagcagagaccaagtttgttcattctgcacacatgatacgcggagataccttacggttatccgcccccctttgccattcagacacagtcgtgtccgttggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgccccccctttgccattcagacacagtcgtgtccattggcaagcagagaccaagtttggtcattctgcacacatgatacgcggagataccttacggttatccgccccccttttgccattcagacacagtcgtgtccgttggcgagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgcccccctttgccattcagacacagtcgtgtccgttggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatcccccccccctttgccattcagacacagtcgtgttcgatggcaagcagagaccaagtttggtcattctgcacccatgatacgcggagataccttatggttattcgcacccattcttttgctatctgtaagacagaacgcttgatagcatgcaggggctgacacagtcttctgcaccttttgttcctctgggaacaacaagtcatttgcatgtggagattttatggtcacccgcgactctcgtcgaaacgagaaggacgaaattagtgtcttatctttacttttcttttatctccaataaaagacaagtaaagaggggcaactgtcataccctaatttcgtccgggaacctttgctcgatgacatgcgaccattctttggtccttgtgaggtgcttggcacccatcattaggcaatttatgaaattccaggacatgccgaaaaaccaaaaaaaatattgatgcacaatccgtaagtttccgtgacacaccggaaatcaaaaggaagcatcgttgcataattaagtgaggttccgtaacattccgtaagtcaaaaaggggatgattatgtaattcgcaaggttccgtaacattacggaaagaaaataagtatcgttacgaaattcgtaagtttccgtaactttacgaaaaaagaatcaccaaaaaaacagcagagggggtgtatttagtaaaaatgggggtgcaaatagcacccaggcccacttgggccctccagaagattcctccagaaggcggttgcttctggaggaagcaaccctgctcgcctgggcgagctgagctcgcctgggcgagctgggcggcaagcatctcccctattttgctataaataggggagaaaatgaagaagaaaaggatcccagccctttaggcacttctctctctttggaatttgcttggaaaaattgtttccgtgaagaaaatctaagccgaggcgcttccgaaacgtttccgtaacgttttccgtgaggaatctcgcaaaggtttgaaccgttcttcgacgttcttcattcgttcttcatcgttctttgatcttcaacgggtaagtacctcgaaccaagcttttcgattcattctatgcacccgtagtggtccacattgtgtttcgtgcattttgattctcattttgtttactctttataccccctgttgacgtgcttaagccattttacttaagtcgtttctcgcttaacttaaaaataaaataaatttccaccgaacgtttgaattgtattatccattagcttcggttaaaataaattccgaccgttcggtcatgccgtaaccacgttggaaatcaaaaagaggtaaaaaataatataataatcaaaaagacatcttttagtaaaataaagcggaaaatcaatcggacgttttctctttgggatttctcattcttaaccgaattgattaataactaaagtgaaactaaggctaacatcaactcgcctagtcaagctcgtccacaaaaataagcttttgaagtttgtcatttcaatttctcactaagtaaaat

SEQ ID NO: 180 - DNA, 34908 bp, Glycine max
  misc_feature (34905)..(34905): n is a, c, g, or t
tcactgaatatattaataataaaatttttatataaataagattcaaaggataatcaccaaccaagaaattttatggaagtatttatcaaataattacaatagatatataacataaaaaaaagagttgaattgaataataatttttcatgccatcatttcaaaagaattactttaatcactctctttatattattattattattattataacatcttcacaatattttttattttattagtatttattgattttatttaataaaaaatcacacacttttctttttgcacacatctttaatctacatataaggatattcaaatcttgacttcattaatatatattattgtttttagggatcaattagcatgtgtcttttctttaattctttctcttttaatttgttcaacatttttattgtgttaataattttttaatctcatttttttattttcctcctaacaaaatttattctatatataagaattaataaagatttaaatcttttaccacttgattaaaaaacataaattactatcaattattttaactttttataaaatcatgattcagatctttatacaataacatatctcatcatgtgttagttgtttatatcatcactctttaaatctcttgagtctttagtttagaggagctaaattcaaaatagaaatatcaagaaagtaacatatgtgaggatcaaaagtaaagagactcccaacgtgataagtcacccaccaccataataatacaaataataaaaataaaaaagaccatacttttgtcttgcacagcagaacgagtgaaggtgaagagagttgacttaagccaaatctcatcacatcagttcatagcaaccaattcccttgcctttgtctttctactctgatcatcttttgttcttgagataatggctgcagcactggtcggtggtgcctttctctctgctttccttgatgtgcttttcgacaggctggcttcacctgactttgttgacttgatccttggaaagaagcttagcaagaagttgcttcgaaagttggagaccactctcagagtggttggagctgtgcttgatgatgccgagaagaaacagatcacaaacaccaatgtcaaacactggctcaatgctctcaaagatgctgtctatgaagccgatgacttactcgaccatgttttcaccaaagctgccacccaaaacaaggtaagaaacttgttttctcgcttttccgatcggaagatcgttagtaagttggaggacatagttgtcaccctagagtctcatttaaaactcaaggagagtcttgatttgaaagagagtgcagtggagaacttgtcatggaaagctccatcaacatctctggaagatggatctcatatatatggtagggagaaagatagggaggccataatcaagttgttgtcggaggataacagtgacggtagtgaagtgtctgtggttcctattgtgggcatgggtggggttggaaaaactactttggcccaattggtgtacaatgatgagaatttgaaagagaaatttgattttgattttaaggcatgggtttgtgtttctcaagaatttgatgttctgaaggtcacaaaaactataatacaggcggttactggaaatccttgtaaattgaatgatctgaatctacttcatcttgaattgatggacaagctgaaagataaaaaattcctaattgttttggatgatgtttggacagaggattatgttgattggagtcttcttaagaaaccatttcaatgtgggattattaggagaagtaaaattcttctaacaacccgcagtgaaaagacagcctccgtagtccaaacggttcaaacctatcatctaaaccaattgtcgaatgaagattgttggtcagtgtttgcgaaccatgcgtgtctttccttggaatcgaacgagaacacaacactagaaaaaattggaaaggagattgttaaaaagtgcgatggactgcctttagcagcacagtcccttggaggcatgttgagaagaaagcatgacattggggattggtataatattctgaatagtgacatttgggaactttctgaaagtgagtgtaaagttattccagcactgagacttagttatcattatctccctccacatttaaaacggtgctttgtttattgttcgttgtatccccaagattacgaatttgataaaaatgaattaatcttgttgtggatggctgaagatcttttgaagaaaccaaggaaaggtaggactttagaagaggttggtcatgagtattttgatgatttggtttcgagatcatttttccaacgttcaagtacaaatagaagtagttggccttatggtgaatgttttgtgatgcatgacctcatgcatgatctagccaaatcactcggtggagatttttattttagatcagaagaacttgggaaagaaacaaagatcaatactaagactcgtcatttgtcatttaccaaattcaattcttcagtcttggacaactttgatgttgttggtagagcaaaatttctgagaactttcttgtccattatcaattttgaagctgctccattcaacaacgaggaggcacaatgtatcattgtgtcgaagcttatgtacttgagagttttatcattttgtgacttccaaagtttggattctttgcctgattcaataggtaaattgatccatctgcgctatttagatctttctcattcaagtgtagaaacactgccaaagtcattgtgtaatttatacaatctgcaaactttgaagttgtgtagttgcagaaagctgactaagttgcctagtgacatgtgcaatcttgttaacttgcgtcatcttgagatacgtgaaactcctatagaagagatgccgagaggaatgagtaaattaaatcatctacaacatctggatttctttgttgtgggcaagcacaaagagaatgggatcaaagaattgggaggactttcaaatcttcgtggtcgacttaaaattaggaacttggagaatgtttcccaaagtgatgaagcgtcggaggcaaggatgatggataaaaaacacattaatagtttatggttggaatggtctagatgtaataacaacagtaccaacttccaactagaaatagatgtgctttgcaagttacagcctcactttaacattgaatcgttgagaataaaaggctataaaggaaccagatttccagattggatgggaaattcttcctactgcaatatgatgagtctaaaattgcgtgattgtgacaactgtagtatgcttccttcacttggacaactaccttctctcaaggtccttaagattgcacgattgaataggctgaagactattgatgcaggtttttacaagaacgaagattgtcgttctgggacgccctttccctcccttgaatctctggccattcatcaaatgccttgttgggaggtgtggagttccttcgattcagaagcttttcctgtgcttgaaattcttgaaatacgtgactgccccaaactagagggaagtttgccgaatcaccttcctgctctgaaaacacttacaattagaaattgtgagctgcttggctcttctctcccaacggctcccgccattcaaagtttggagatacgtaaaagcaataaagtagcactgcatgcgtttcctctcttggtagaaactataaaagtagaaggaagcccaatggtggagtccatgatggaggccatcacaaacatccaaccaacttgtctccggtctttaacattaagggattgctcgtcagccgtgtcatttccgggtggtcgtttacctgaatcactgaagagtctgtatatctcggatcttaaaaaactggaattcccgacgcaacacaaacatgagttactggaaacactgtcaatagaaagcagttgtgattcactcacatctcttccattggttacctttccaaatctcagagatcttgaaatcagaaactgtgaaaatatggaatctcttttggtatcattctggagagaaggattgcctgcgcccaacttgattactttccaagtgtggggctctgacaagttgaagtcgttgcctgatgagatgagtactcttctcccaaagttagaacgtctcctcatatccaactgcccagaaattgagtcgtttccaaaacggggtatgccacctaacctgagaatagtttggattttcaattgtgagaaactactgagcagcctagcatggccatccatgggcatgcttactcatctctatgttgggggtcgatgtgatggcatcaagtccttccctaaggagggtttgctgcctccctcccttacgtatctgtatctaagtggattctcaaatctggagatgttggactgcacggggcttctccatctcacatccctgcaacaattaaccatagacggatgtcctttgctggaaaatatggtgggagaaaggcttcctgactctctaataaaattaaccataaagagttgtcctttgctgaaaaaacgatgccggaagaagcaccctcaaatttggcctaaaatttcccacatccctggcattaaggttgacaatagatggatttagccaccaaggaggaccaacaggtatcttctaagtctaaccaactagaaaactagttctgtcaaggatatgtttcatttcatgtctttctccttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgataaatacttaaatataatgattctccggaaaaatgttacacatcagtattgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgacgtcaaattgacactttctcaatagctaaatttttatttgtgaggttttttgttaggtacaatgtgaaggatgaaaaggtgtaccaagtgaactttagaaggattggatgatttcagcttatctcttatctcctgtcctataaattaatagtggtatgattattctaaaaatatgatagatatgtagatacgtaagaattgataaaagcataataaatatacaattgcaattcggtaaattgaagaacatacatacttcttagacattgctaaaaacaaaatcaaaaaattgtagatcattttttcctattgttcacaaataagaatggtactatcaatgatcaatctcatttctttcttgaaattatctataaacaaaacaattttcatatttggttcatcaagaaacaatactttttatatttctatattatatttacttctatgttacatgtcactatatttgattatcataatttttttttaaaagaattggtcactttacatatatgtaccagtgaaatatatcaatatattggtatcggatatagatgcatgaagcaaattaaagtatcagtactttgtagcaaaacacattcttcaaatcatgacatgaggtaaaaaaatatgatgatatttttgtaagtattggaaaaaaaaaaaaaagtaaagcttctgaaatcaaagagacactaattttccacaacatccttcaattgggcccaagcttcctttcctattgacaaataactggttgttagtgccagctttttcttttttctagttttccattgatggttaaaagctaatatgaacctgtcactccttaaaatttccaccaaagtttggtaaataaatatataggagagtgaataatgcaagccttgcattctatctctaagttactaggtatatgaaacaggtatgggtatggttttagaaggtatgtggttcatcactatttatatttttactacaagaaccaggtaaactttattatggtacagtaaatttagtgtgaggttgtaactacgttatatccatctaacttagcacgataattaaatttaaaagcaaaaagataagaaaaaggccaatctaacaattgttacctctcttgcatgaaaaaatcagaaacaaaagccccactctttcctccatggtgcctgtaattaacaagcacttcaaaaatcaatgttaattaattaatttccataagaaaaaaaagacagaagctaatgaaatttaaggggtacaacaaagatttgtagaacgatcattaatattagtgcaacacatcatgatgaagtgcatgacataataataatgtgaaaccaatcatgataagaacagaaaataaatcagtgcaattacatgattagaaaataaagaggcgatatatcatattcctattgatcagacaatatgacaacgtgttaaacaaatgtgtcaggtgcaataatgaggggatagagaagagaaggatgataaagaatgtggttatgacttctacaaagtcgaattatttacttttttaattttttatattttccttttcacttttctaatagttgtccgattaagaggagtttatagagtagattaaattggttttgaaaaagagaaatatcatcttatacaatttttggttttcttaattcattgttcaattgatgtagtttaaaatttaaatatgatttaataagtttggattgatctcgatcttaagttttaattttaattctattttttcaaaaaaaaaatattaaagatatataataactgtgatacaaagtaatttaaaatattttaccaaaaaatgtaatttaaaatatcacatatatataaatcattttaaagctaatagtaatattttctaaaaagaagctaaaagtatatctctgttatacaagttgataattatatttatatatacttgaatagttactgaatattatatttaattaaatttacttttcataaataatttttaagtaatgtaataatttttatatatatatatatatatatatatatatatatataataaataaaaatataaacatcaatgatatcataaaattttggtaataataatttttaaaaaaaaattgtgaattaactaacctttcaggttctagagtaatttattaatccaaattgccttgaagcatattcccatgcaagtcaagttgagggacttgatggaggccatttctgaaatagagttaggagaagttattttcagccaacgagagattctgcaagctccctaatttaccaattcccaatggcaaggatgaggaaaagagtttataagagatatccaagaattcaaggcttttgaaatcagcaatgttgtcaggtagtgttcctcatatggcaaggatgaggagactttatttcatgtaaaaaatattttcctaggagtatatatatgatatatgattatgttgggtcatatttatggtatctcaaggtttcaattgacagttttggctatctcggaaattttccttgtaccaaaatattaacaattgaaacatgtttcaaatccagttacttttggtaccatagaattgaaattaatttatttcaaatacattgtattcttaatatattaaatatgttaatttgttattttttttaaaaaataatcattagaaacaagttccggtataggaggcatacttagtgtttaggctaaggaataatgccaccgggttcaggaacaagcctgttgaggtgtcccttaacgttccgtgacatccccactcttgcatggacattctgtgcagagaaacgatgggtggatggaggtaagattgggtgagttctataatagtcactgatgagaaccccaagagcagcattgaagttcgaggaatccaaataagaccagcgtaaattatcaatttcatctcttaaatagtcactaaaataaaatataaattaattctttcaagtattgaaacattcttcaaattaatccttatacattgataaaatatttcaatgtatatatgcattaatggatatttaacactttagaaattacttatatatgattttgttattttaaggactatttataagaaagagtaatactctagatatcaaattggtagttaatttaattactcttgaaataagcatgctcaatttataatatgttgttttgttggcaattaaataagcacaccctctctagaatggtgtgtatgtacttttctgtatatgttgttttgtttgtatacttttgcttgcatagatcccaaaacaattgggtgattttcattcttctataaattttcttataaatatttaagaaatttttgctaacacaagactggtgatatgatgttaagattgacataacaaggacgtgagagttcaatttttcacatgccatgtcacccatcatagtaccttgttggcatgtattaagtcaacaacaaacttccattttaaccatatctttgatcaccgcaaaaaattattaaatttactattaaattgtttatatttatttttctttattgttgggctgagatttttttagttactaaaattataaaagtttttttaatctctgaattttgataaattgttctttttagtttctgatttaataaattaatattttataataattttaaaatgaaaaattcaatggctaaaaaataaaaatcaattaatggttgctaaaacctaaaggatgttgctaatcagtgccctaaggcattagttaataaattaaaataaaaaaatatttattatgaaaatcataagagtatgtaaaaaaaatcataaataatactattttatatatttcaataaaaaaattattattttagttctttataaccaattaataccttaaaaacactagttaacatttaccataattaaattaactaattttgaaataaacttcaattattcaattatgtcttaataagcttgatttttcccttactactgcaagtttgcatcctttattaaagtgaagtgatgaaatgttgtctgccatttacgaatatcactgaaattaaagttgttttctagttgaatttataataagtttttttaattgataaattttaatcgttattttgtgagtttttgttagtataaggaagtaaagtcacaaattttcttttctttcataattttttaaccatcccatcaatattatatctccatttacaataagttaataactagcaagatacccatacatttacgcagatcgctctccttttttacgcatattcaaaatacacttgcttaaaaaagataattagctatttagtatttatattcaataaacatgaaaaaaggattagaatattcaagcaaaaaaaaaatcaaaatcctaatttttaggctatttaaatcattgtcttctattatttgaaaattgaaactattattcatatttttacctgttttatcttcataaattctattttaatatatttattatgtatttatgtaaaaaaatcaacactattaaaattaatttaatttgtgatattattcagtatttaatattttgttataaaaatatatttaataaattaatattaaaatatttcttatataattatgaaaaaatgatatttaaacttattttataaatattagttaataaaatttccatatatgaagttattaaaaaaagagacaaaataatattttgtaataaacatattacctaattagatttaaattaattaatagtataaaaatttcaactacataacataaattattcaaaaaatatttcattcataaaattattttatacggtttctaagtaaaattgattttataggatttcaaatttttaaaaagatatcgtggattctttaatatgttgttatgttaaatattcttaaagaaaaagctttgtcacccataataattggcctgtaatgacgttaaacacgtgattgtttttcatgaatgatatttttggtctctatcataaaaaatatatattaattaaatgtattattgagtaagtattttaaaagtattgtattaaaaattatatttaataattaaattttagtagttattatatattatgtagaagtgattataaagtaaaaatgggttttcaaattaaaaaaaaaatattatttttactctttgatatacaattgtgttaactactaggcgaaagaactgtgtcatttgtaataattttgagtaggattatttctcatcaatgattattaagatccctgtcatgattaaaatgattttaatttatgatattattaagtttttgatatgaatttgtgtgaaatacttgaagaaagagcatattcagtaagtaacctaaaactattttgtaataaaaatacattttataaattgattttaatatttttattactacatattatgtaaaaattaaaattaatataatttatgattttattgagtaagtaatttaaaattatattgtgataaaaatatatttaataaaatgttatataattatgtaagaatgatttccaaataaaaataatattataagatttgaaagtaaaaaaaaaaatactatttcagttttttttatgtgtagttgtgttaactacttggataaaaaaaatattgtggtctataatagtctttggcaagattttcttgtcactaatcatatttgtaatctctagcataactaaaattattataatatatgatattattaagtcttttggtatgtagttttataaaatattggaagaaatagttttgttgcatataataatccaatttcgagtaggattttttcttatgaatgatatttatgatttctactacaaaaatatttaaactaattaagtttatgagattattgacgaaatgatttaaaattagttttaataaaaatatatttaattaattaatttttaacatagagtcaaaacattattttgtaataaatttgttaactaattaaaattaaatttatttatagtataaaaatttcaaccttataatataaatattaatgaataaaatatttatttataagattatttaattttattttatatgatttctaattaaaactaattttataaaatttcgaattaaaaataaattgttgagtctttaatatgcaattgttttaattactcgcgaaagagttttttttttcctataatggttggcccataagaagaattatttttagtcattatcccaaagagaataaaactaatttaatttatgctatttcttagtaaataatttaattttttttaaaataaaaatactaagtgactaatcttcctcaagaattctgagtgcacataatttgactattcccctcccaacccaatttatttcatacacaaggatcaacggggactaatatattaattttaatatatctattatatatttacttaaaatgattttatagaatttaaaaataaaaataattattattgaatttttggtttgcatttgtgttaactactcagggtaggaacattgacgtccataatgacattgagtaagattgtatcccatcaatgatatttgtgatctctatcatatttaaaattatttaaatttatgatattgttaaatctttaatatgtacttttatgtgtgtttcgttgcatttgcacataagatctctagtaggattattttacttgaatcatccaaggttgttaaactcatgttttaaatcgtagaattgtatgattttacgattccactaagcttcagcgagttaaatcgaaagcagaattgaaaacggaatagactcatctgatttagcgcaaacttgggcgagtttgggtagactcgcgagtctgctacgagtatgtggatttacgaaaacccgaaacggtgtcgtgttgtagctacttatttgagtagactttgtctaccttgttcgagttatgcaaagtgcaaaattgtttggttcatgcttcttggcttcttgctgtgatgcagtcggtgctagagtgctacggtggggtgcgacggtgaaaggaggttttcggtgttggagtgcgactgtgcaagtgtgtgacacagtgcttctggatcttttgttggaaggaggttttcagtgaaaggaggttttcgatatatgggatcaaggtgatttgttgcgaacaaaagctaaacttcaaattgcacagggccagttaaggaacaaaagctatactgatatacgcagttgctagttgttcttcaaattcagagtaaaggttttaatttggttctgggaagaagctatacaaggtttgttgttgtaataacttatgctgattgaatatttctgaaccatgggcctttattcctgttatttactgttagaattggatgaatgcagtctcatgaaccttttgaatttattagatttttcaagaaatttgtgatcatgggtttgttagaaaaaaggaagtgtcctgatagtttgtaccttagaaagtgagaatattgatatataggaaagtaatagtgagagtattgaagatttgatcaccattttatttggtttgaaatggaggcatttcgtgaaaaagtagagtgcagaatgcatagagttcctcagaatttcgcatgtgttgatgaagctttttgaagcatggtacacctttaagggcatactactgttgggttcatatattttttggtttaatgagagaattgaagatttgatcaccattttatttggtttgaaatggaggcatttcgtgaaaaagtagagtgcagaatgcatagagttcctcagaatttctaacatactactgttgggtacaccttgaagcatattcccatgcaagtcaagttgagggacttgatggaggccatctctgaaatagagtcaggagaagttattttcagccaacgagagattctgcaagctccctaatttaccaattcccaatggcaaggatgaggaaaagagtttataagagatatccaagaattcaaggcttttgaaatcagcaatgttgtcaggtagtgttcctcatatggaattgttggacaaggagggtttcactactgacaaactgctaactcagttggagaatgttgtgtaagtgttaatgcaaaggacaataccgaaatgcatgaaaagatcatcatctcataacagactctttcacatacgaccgaccacctcaactgcaatggcatattttggtgaacgaaattgttctgactcacgtagattcaaagtgaatattcataaatcaggcattttctttgctttgtgacaatgtcactaaaccttcaattagttgatcttgttctagctctatagggtaataaaagtatatcaatgtctgcaaaatacatcaataagatcaagacaccaaaatatatatatgtgcttgaattatttataaacttttattttgattccgggttacaacttatcttaaaatattttcttttttctctgtttcttctttcaagtttttaatttaacttcctgggtaatctagattccataaaatacttctggaaatgcagatatgatcttgttttttttttttgtattttactattctatatattttatattagtgttgtttattttcttaaaattatcatacataattatatatgctatatacttgttgatagggaagaagatagaagctggttttcaaggaccagggcctccacggagagaagaatgagaagaataagggaaggaacaattgtatattccattgattgatgttgttattacatagtattatttatactgatttctcaataatcgaatttgtctttttgtgctacagaatatcaggaaattgttaagtttgtctattcctacccgaccagcatcattcttccagatatgatgcacctgcttgtttcacacctaatccttgaggtaagtgggtcttgtaattgctctcttggtcttgttttctaattgcacccccttgcttctgttgcttgcttgctgcaagttcccactgattcaaattccaacagttctgcaaataaaattgaagaagaagctagaggtgggaaatactcaagtcattctcttgaaaaagttgctgcaatgatatgcaacaaaatatcactatacggagtcaaggtaattattgtgttcacatgaacatttcttccatgaaaatatatatttttttactttgtaatctctttatagtatgcatggaaaattaattttctgatttttttctctgtagtgttatatattatttttaatcacattttcttatttattagtttgtttcttatttgacatcatgtaaatttggagatttgggttagaaatgtttttggaattttcctggttagaacttgataggtccataatgaaggtatataaaaggatagggaaaagagggggtggggaatagaaaaagaaaggacaaatgggcctcagaaacaagacatgcttgtgtatgacagcagaaagaatcagccgtacaagttgcactagctgaagtggaaaaggaacataggttggcataatggaatggatagcatttgatctttaataaatttttgctttgtaataggttcctaatatttaaaaagttttgtttgaaatacttatcattagtcaaaatctgttatttgctcacacgatcgttaaccagccacacagacatgtcatgtgtgatttttgtctgactgagattaggattaatgataagaaactatagtcaaaatcccttgggcataaaagaatcattcttcagcaaataacggattttgactaatgataagaaactatagtcaaaatcccttgggcatcaaaaaatcattcttcagcattcctctacgttttcacacaacccattatagtttcttctatacctttcttatggatttgtcactatgacttcgtcactcgtgaagatccaaggtgaagaggtcctcaccaacgatttttaggatcttgcaatcaattttacattttcaaatcaaaccaagccaactcccaactcaagaaattcacatggataaggtttctaagagaacacatcaaaatagtttcatgggtagaagaaggtcaacaaaaccttaccctaaaatgcgattccgctcggtccattgcatagagcacgaaaaaatgagtgggatagcgatgtctgaacttgtcgtcgacctttcatagttgcgagctctttttgcaaacccttgctttcatggttgtctcttcttgttctcccttcttaaaggtcaccaccaacccagccatcggccaccactggtgttgccagtcgtgccactgctcgtgccagcgccagctaccaccagtaacttccttcaactctcaaacctcacttctctcccagtctctctctcacacttggccctcaaactcacttgtgtgtcgtaggtgaagagaaggaaatgatgaaaacaaagaggagggttttctttggggaaggggggtccatgagtgattttttagagaaggagatttgttgttgccatggggagccatggttcaagagaagaaaaaaagaaaatgggttagaattattgttgtgttgctgccatggggtttcaagggaggtttggggggttttggagacacaatagcggtggtgtggagctagtggaggagttggttggggactggtgggggtggtttggaggattcggggacttaatgatgtcgtttttttacttttttctataaaaaaataaaaaatcttacgtgatcggttatcgatcacatatgaagataatggatttcgactaacggcaggaacttcgaacaaagctttttaaatattagggacctatcacaaagcaaaaatttattagggaccaaatgcaaaaaatgagtatttatcagagaccaaaaatatatttaaaccattacctaattgcaactcactatgtgataagtttgttgacttttaaaataattattttaaagtaattcaaacaataatttataatagtgtaaaatcattttacatcatcaatacataagtattaaactcgatatctctctctatatattttctgttcgagattgattgaaattatcttatttgcttaacatattaaaatgcgtcatttttaatgatattattggtctatagtttttatgtaatacatttaataatgtttagaaatatttgtatataaataacttttatctattttttcaccagagcctatgaaatgtaagcacaggtttgttaatgagtagcacaacatggacagtttgtcaaaggcccaatagcatctttaatgggattcttgaactcaagaaccctatccactagatctactattattcttattaagagttttttaagatggagattgggttctaggaaaagaactactattttttcaaaaatattattttttcttgtgctagtaaaatctaataatccaaattggattctactattagaataacaaatgatagaagttcttgcatcctatataacatcatgggactcacaaaaaataatccaagaacctaaaatggattctttgacaaaaatgttctaagaatctcaatattttcccacttaagaaatataactatcaaatcaatataatatgaaacgagttcaatctttattgattcacttgacgcaagctatatgcacaactgacataatagattttaattctaaataacatgcaataaaaatataacaaacctgttccggaaaaagcctcctcaaaatgaagcacattcagtccccccacaatttttacaagttggggtctttatgctgcatcaaaatattccatcatatcccgcaaatgtttcgtgctattaagtttatgttagttgtcccttcatgatgcatcaccagcatatcataaacaatcagttaatcccttattctgccgaaatagtcggattatcgtcaatcccccttaaggtggtcgtttgatcccgcttggcaaggcccaactttgaaagtgaattgacctaagcctcttttatgggcttgatgcgtgatagaagatcggaacataatccaatacattccaatctgaaccaaaagataaccccttagcttcaagcacacagtgcgtaaaagctaaagatgtagaagatcggaacatgatccgatctagaccagaacaaaacctaaaaccaaactactaactgatctataattttttatacatcataaaactaaaaaaacaaagcaaactaagcacataatcttacaatccctactgaatttactaaaagagacacagatagttgaggtgggaaatgttgccaaaccagaaatgaattatcacgggaaagtatggctgatgtggttacaattaggagtcttaattcatcttaaagcattaatattttttaacttaacaaatataattaaagagaagtaacgaataagataatgatctaaaattcttgtattgattgaaaatagcgtaaaaagatgtttcaaagataatgatacaaactctttaaatgcaaatggttacatgcacaaagcacgtatatatatatatatatatatatatatatatatatatatatatatatatatgaatatatctacgtacattcatatatgtatgtatatgcaaacatatatacatggatgcatatatatatatatgcactaacaaacatatatacatctggatagagagaggatcagaatagcaggacaaagacaaacttgtatttgttgcttccatactagaattgcattttcttcagggttagatgcatcaactgtgtgggagggaaatttattaacagcgctaagtattctcctaaccttaagcaggatctccttctggtctcttgccatctgagcttgcatgtcaatgatgaaaaacctgacaagcgagtccgcaagtgcctcaagttgttcctggtaacaagctttgtcgcattgaccgaaaaaaccaaggtgacgttgaccaaaaaatagtcctgacaagatgttggtaaaaaaatataatcggttgatatcgatcacaaacatcattgactaaggttaacaaaaaaatttctaaccgacattgatcaaaaaataacttcgaccaaggtcgatcaaaagaaacgtaaccgatttcggccaacagaaatattttatatgatagcctttagttgcaaaaagtgtgaaccagggggtattttgacagccgtaaaacatatctcatggcagtggttgttatataaggcaaaaaaccatgaactttcttctcttgctggtgtttggagccacttcaaatgtgattgatgttagagaagttaacagtggcattttttaggactgaaagttaacttaggagaaaccatttttttatgtatgtaatacggtaacacatgtacctcttgcagagattggggagaaattgcaacttttctttttacattttgccttaaaaaaagtgttcatatttataaaaataattttctatttaacttggatattttttctcatactactacactaaggtatatacaacctaaggcgtgtttcttaatttggagagtgatgcttgattgattgactaccaacgaaggataatctaaaaaggagaaacaccatttataatcctcatgagtgcttatgtcccttttgccttgaggtagatgagtcggtatctcactgtttcttctcatgtcataaaattcttggtactaatttggaggcaatgttactcttggctgctggctgcatgtaaatgtggtgttgccacaatgaccagaatcacatttttggcaagattctgtattcgtaagttcaaagaaggaggcagatgtatggagggcggtgtgggcatcagaaattttggtgtgtatggaatgctaggaatgagtgtatgctaaggaattaatggctctttcaatgctgagaaaattacgcagaatatattattctttgcacgatcgtggattaataaaagccagagtccctaattttaattattgttttacttaatgatatatggcacctggagcttgtttcatgaagagacaattttgaatgaaatgtgaagttaatttgattcggtggtagctgctcttcgagtgggatcatcccaaatgcaaccgatgtttatgtgcacgatggtgggggctggttagtgatgccgcatcaatgttgcatggctttagacatgattttaaattgcaattatgattgcgttgcatgcaacgaacctaaaaatcttacattgtggataattatggaaaaatacaaactgatgtgatcataattataattgtgatgtgattacagagtcaaaatacattagcgttatgactgcaattatggttgctgactacattttaaaaccatgactttgggtgtaatggtccatgttcgaagctagctatctttctttctactgtcactggtgtatatgtttttggatcttaggtaattttggtaccatttaatacaaatcattttgttggaaaaaaaatacggtagcctacatgcaatatacaaaataaaattgaattactatatattatcataaatagtagagtataagaagtaaagaaaattctaaagataaacatgcatttaaaaacatatgaaagaattttttaactatatatataacatctttaattagcttaatagaaatgcgaaagtacaataaaaaagcaaaaacataataggcgtgacaaatcggttgcttatatacaataaagacaataaagtttgaaactaaaaccttatccagactatccaaatatccctaattaatcatgaaaaaattagaacagaagacatttaataactatagcaacagtaacagcagcagctatagctaatggcgcgatcaccgaatcggaaaacttttcatcattgaagtattctatttcactaaccctaagcaagatctcaagttgatcgcgtgcaataagagctggcatttcaatattgaaaaacctctcaattgagtctgcaagatctttaattttagttttccacggtaagaattcttagccacaaaattgtatttccctatttttgaacacttgtaaacaacctctttgctcttcctcaatagttgtatcagtggctcaagttcctgctgtgaacgacccaacatattcctgtacttacctatctcctgccatgtttacgctacatattttctagaatgttatttgaatttcattaaaaatcataagaagcaagtttgaatttttcagtgaaatttttacttaggtttagttagacaaaccctatttaaagctatattgttttgcttatcggaaccaaaccaattagttcggtttgaatttcttagttaaatcaagtctggcttaaaccaaatcgagctaaccctaggttaattgtttcaaaggtcgggttgaagctctttaaacttgagaatgtgttctacaaaccgaagtaccttattatttaaagaatatctaatatttttttgtttttacattattgttgaatccattttatatgattttttttttacaaaatattaaactttatttactaaataagatttatataaaattcatgaaggtaaaagtaatatttttatcttttaatgtaaggcttggtttcactttcgtccttcaacttttttttatttgatttatttcagtgatcatttaatatttatggattcttccttaaggaatcttgatatttttctatagttttaattgttcttcggttatttattcggaaattgagaggggatcatcacctccaaagatttcctcgctcccattaacaaaaatgtctaaacaattaccttccttctaaaatttttgtgaagtacctccactaattaaactcaacatattctcccaaacttcattttctttgaaaacaatgttgtctaattcaagacgctttgatataaaatatttagtcgctagaacgagaaaaaaaattgaataaaaagaagggatttttttcttcttaatgtacttcatgctacttatttgttggcaatcattattaatatatattatcttatatgagacaattttcaacatttaaatgttaattttgtaagtatcttggtagtatccttttttgataaggaatagatattattttgagattatattatgatgatgaattgtctcataaaaacacgaggcaagcacttgaaaggaacaaattctctaatttcttagtgggtagtgggagagaggaagtaaacttgcttcaatatgcaaatgacgcttgacgcactctttacaggagaagcaaccatttctaaggtgcttaccataaaaagcattttgagaggctttgaacttgtctcgggcctcaaaatgaatttccatcaaggcttttgtggtgccttgggagtggatattgataccttgatgaattatgcaagcttgttgatttacttgagacaaactatatgcacaactgacaaaatggactttaattctaaatagcaataaaaagatatataataaacctgtttcagaaaaggcttcctcaaaatggaggctacttcaatctagtacggtagttgacttactaagtacgaaacaacaaattattaagttgataattaattaaacatgattttaaatacttacatatttattcacatgtaactataaagatttagtaagagcataaataaaaaatgttgttataatatataattttaaatttaatataataaaaatgtgtttgcaaaatagaaatataaatataaagcgtgacaacacatgtttttcgttaataataataataataataataataataataataataataataataataataataataataattacaaatgggttttgacaaaatcatacctggcgaaaatatgcagtttagtgacggaattaatttgtgattcatgcaatacaatttgtaccaatcatcatcatcatcataatctctttttcgttttatttatcaacgttgctacttagtacgaaaattatttgcacaaaatacaaacagaatgatgctatctgttatgaaaggtaaatccacacgaattacacgaaatatagaatggacggttatgattttataaaatgaatatcgattaaaaaaatttaaaaggcatgtaaaaagagatttacagacatcaaacttcgtgcgacttttacaaaatcctctttcctaacacagcattatattttccatacacaaaccgtaaactatagattctaaagggtatacctgacttattaacaactttttaaaaactaatattcattaaaaataccaaataggttttgacataatcacacctcgttgcagatttgacaaaaaagaattctaccaatttatttttcgtcaaattggtgttaaaattaaatatatgtgactagtcaagtaggtgataacaagttgcagcacttgtatatatgagtgatgcaaaggattcgtgcaatttatttacgaaaattatatattggcatgaaacacacgaactgtaaactatatatagtcactaacttgtatacgtacgaactgtaacaataaattttaaaataaaatattaattacaaatataaaatgggttttgacaaaatcgatcacacctcgggcagatttgacaaaagataattcgccacgaattctttttcgtcaattatttaacacaaccttccttttacgaattgcacaaatccacttttaaaatacaagaaaattttgttttaaaaattcagccagccgacatagaggtgtatgcaggtaagtttggattgagtttcatcatacctatgacttaagaatgagttgatttgagtcatttgtatacgattttaattaaattattgggttaaaatatttaaatttgtatgctatttattaaatccaatatttatataagctaaaattcttattaattagaatactgaaaacattacttataaattaaatattgtcagatgctgcgactaagtgaggtggtggaaagatgtcaagagttgaactctaatttttgaaagaataacaatgacactcggtacttattcaactctcttgttatgcacgaaacatatatttaataataaattcacgcgcgtatttataaaattatatgagaattttttgtataaaaatttaaacacataaattatattaaattaaaatgttatggtaattttaaaatatgaatgataaaatgattcaattattatactttaatttttaaataaaaattgatttttataatatttaaagtttataaataatattttgaataattttacatataaattaattaaattaaatgcaaaaaactgaaattaaatatttcttaaaactaattaattattatatgaatcactttatattagtaattgcgagctgcttgtctcttctctcccaacggctcccgccattcaaagtttggagataattaaaagcaataaagtagcactgcattcgttacctctcttggtagagactatagaagtagaaggaagctcaagggtttttattttaaaaaatatataaaaaatgaatttaataatttttttaaattaaaaaataataggagcaaagagaagttgggttccctaaccccgacttctctctgcaagctaaaaaggagtgttgtttaggaaacaattttgaggcaggtgtattttgaaaaaaattgaggagagagcaagtgtagtggagtaaaaaaatcctataagattttgtttgatactaaaaagaaaaaaataattgtgatgagaaaaaataagttagaggataaatatcttcaacacttaaacaaacaaataaaaaagtttttctagaaagttcacttaaatctattttcactattgataaaaatttatacctgttgatttaaaataaaattatattttataaaaattatatttattaaatatgataggagaaaaatattttttacatatagtaaaatattttcatttgctggacttaaattttctttatctctcattttagtattgttgtttgagatgatctcactaaatatattttacttgactaataataaaaattttatatagataagattcaaaggataatcaccaaccaaaaatttttatggaagtatttatcaaataattacaatagatatataacataaaaaaagagttgaattgaataataatttttcatgccaaattactttaatcactctatattattattattattatcattattataacatcttcacaatattctttattttattagtatctattatttattttattaattttatttaataaaaaatcacaaacttttctttttgcacacatctttaacgtacatataaagatattcaaatcttgaattcattaatattatgtttttagggatcaattagcatgtgtcctttctttaattctttctcttttaatttgttcaacattttttttgtcttaataattttttaatctcatttttttattttcctcctaacaaaatttattctatatataagaattaataaaaatttaaatcttttaccacttgattaaaaaacataaatcattatcaattattttaaatttataaaatcatgattcagtattagatctttataaaataccatatctctatgacaattttaatgattaggttgaaatataaactaacacgaatttaagtaaatatttcactatttactttcacattgaaaaattgattttaaattttaactttagaaaaaaaattctaagttgaggatctttacataacttttggatttaacaaaaaaattcattttcaattttactattaacttattttttaaataaaaatatccaaaacacatgtgcaaactgcttcaatacaacttgtctcacagcatcaaagcacaggaacataattatgcacagtacccttgcagccatccacacatatcaccaagaaaaaaacacacaccactgctccacacggtttggaaagcgagaaagctggccatcactaactttaattatagcattttagaaatataatccatttttttaaaattaacggtagaaatatcatcactctttaaatctcttgagtctttagtttagaggagctaaatttaaaatagaaatatcaagaaagcaacatgtggggatcaaaagtaaagagactcccaacgtgataagtcacccaccaccaattcccttgccttttgtcttgcacagcagaacgagtgaaggtgaagagagttgacttaagccaaatctcatcacatcagttcatagcaaccaattcccttgcctttgtctttctactctgatcatcttttgttcttgagataatggcagcagcactggtcggtggtgccttcctctctgcttttcttgatgtggttttcgacaggctggcttcacctgagtttgttgacttgatccgtggaaagaagcttagcaagaagttgcttcaaaagttggagaccactctcagagtggttggagctgtgcttgatgatgccgagaagaaacagatcacaaacaccaatgtcaaacactggctcaatgatctcaaacatgctgtctatgaagccgatgacttactcgaccatgttttcaccaaagctgccacccaaaacaaggtaagagacttgttttctcgcttttccgataggaagatcgttagtaagttggaggacatagttgtcacacttgagtctcatttaaaactcaaggagagtcttgatttgaaagagagtgcagtggagaacttgtcatggaaagctccatcaacatctctggaagatggatctcatatatatggtagggagaaagataaggaggccataatcaagttgttgtcggaggataacagtgacggtagagaagtgtctgtggttcctattgtgggcatgggtggggttggaaaaactactttggcccaattggtgtacaacgatgagaatttgaaacagatatttgattttgattttaaggcatgggtttgtgtttctcaagaatttgatgttctcaaggtcacaaaaactataatagaggcggtgactggaaaggcttgtaaattgaatgatctgaatctacttcatcttgaattgatggacaagctgaaagataaaaaattcttaattgttttggatgatgtttggacagaggattatgttgattggcgtcttcttaagaaaccatttaaccgtgggattattaggagaagtaaaattcttctaacaacccgcagtgaaaaaacagcatctgtagtccaaactgttcacacctatcatctaaaccaattgtcgaatgaagattgttggtcagtgtttgcgaaccatgcatgtctttccacggaatctaacgagaacacagcaacactagaaaaaattggaaaggagattgttaaaaagtgcaacggactgcctttagcagcagagtcgcttggaggcatgttgagaagaaagcatgacattggtgattggaataatattctcaatagtgacatttgggaactttctgaaagtgagtgtaaagttattccagcactgagacttagttatcattatctccctccacatttaaaacgatgctttgtttattgttcgttgtatccacaagattacgaatttgaaaaaaatgaattaatcttgttgtggatggctgaagatcttttgaagaaaccaaggaaaggtaggactttagaagaggttggtcatgagtattttgatgatttggtttcgagatcgtttttccaacgttcaagaacaagtagttggcctcatcgcaaatgttttgtgatgcatgacctcatgcatgatctagccacatcactcggtggagatttttattttagatcagaagaacttgggaaagaaacaaagatcaataccaagactcgtcatttgtcatttgccaaattcaattcttcagtcttggacaactttgatgttattggtagagcaaaatttctgagaaccttcttgtccattatcaattttgaagctgctccattcaacaatgaggaggcacaatgtatcataatgtcgaagcttatgtacttgagagttttatcattttgtgacttccaaagtctggattctttgcctgattcaataggtaaattgatccatctgcgctatttagatctctctttttcaagaatagaaacactgccaaagtcattgtgtaatttgtacaatctgcaaactttgaagttgtgtagttgcagaaagctgactaagttgcccagtgacatgcgcaatcttgttaacttgcgtcatcttggtattgcttatactcctataaaagagatgccgagaggaatgggtaaattaaatcatttacaacatctggatttctttgttgtgggcaagcacgaagagaatggaatcaaagaattgggaggactttcaaatcttcgtggtcagcttgaaattaggaagttggagaatgtttcccaaagtgatgaagcgttggaggcaaggatgatggataaaaaacacattaatagtttacagttggaatggtctggatgtaacaacaacagtaccaacttccaacttgaaatagatgtgctttgcaagttacagcctcactttaacattgaatcgttggaaataaaaggttatgaaggaaccagatttccagattggatgggaaattcttcctactgcaatatgattagtctaaaattgcgtgattgtcacaactgtagtatgcttccttcacttggacaactaccttctctcaaggaccttggaattgcacgattgaataggctgaagactattgatgcaggtttctacaagaatgaagaatgtcgttctgggacgtcctttccctcccttgaatctctgtccattgatgacatgccttgttgggaggtgtggagttccttcgattcagaagcttttcctgtgcttaacagtcttgaaatacgtgactgccccaaactagagggaagtttgccgaatcaccttcctgctctgacaaaacttgtgattagaaattgcgagctgcttgtctcttctctcccaacggctcccgccattcaaagtttggagatatgtaaaagcaataaagtagcactgcatgcgtttcctctcttggtagaaactatagaagtagaaggaagcccaatggtggagtccgtgatcgaggccatcactaacatccaaccaacttgtctccggtctttaacattaagggattgttcgtcagccgtgtcatttccgggtggtcgtttacctgaatcactgaagagtctgagtatcaaggatcttaaaaaactggaattcccgacgcaacacaaacatgagttactggaaacactgtcaatagaaagcagttgtgattcactcacatctcttccattggttacctttccaaatctcagatatctcagcatcgaaaagtgtgaaaatatggaatatcttttggtttcaggggcagagtcatttaagagtctgtgttatttgttaatttacaaatgccccaactttgtatcattctggagagaaggattgcctgcgcccaacttgattactttcagtgtttggggctctgacaagttgaagtcgttgcctgatgagatgagtactcttctcccaaagttagaagatctcaccatatccaactgcccagaaattgagtcctttccaaaacggggtatgccacctaacctgagaagagttgagattgtcaattgtgagaaactactgagcggcctagcatggccatccatgggcatgcttactcatctcaatgttgggggtccatgtgatggcatcaagtccttccctaaagagggtttgctgcctccctcccttacgtctctgtctctatatgacttgtcaaatctggagatgttggactgcacggggcttctccatctcacatccctgcaacaattacaaatttttggatgtccaaagctggagaatatggctggagaaagtcttcctttctctctaataaaattaaccatggtggaatgtcctttgctggaaaaacgatgccgcatgaagcaccctcaaatttggcctaaagtttcccacatccctggcattaaggttggcaatagatggatttagccaccaaggaggaccaacaggtatcttctaagtctaaccaactagaaaactatttctgtcaaggatatgtttcatttcatgtctttctacttttacgttttactaaatccaattcattctgaaatggaaattgaccttgtatatatgttactgaatctacagagaatcaacaaatcatcaaaggcaacgtggaaattgaccttgtatatatgtttcgaagaagtaacgatacaggtactaagtaacaacattgacaaatacttaaatataatgattctccggaaaaatgttacacatcagtgttgttatattctaacttaatttctccttaagattattgaggccagagtgaaaatgaccgtgggaaacttatttttgtttttcagatatggttgattggcccggagaaactgtacctacccatgaatctaagttcaaatttgaactagtgctaaatgtaacttttaatttaattgatgtcaaattgacactttctcaatagctgaatttttatttgtgaggtttttcgttgggtacaatgtgaaggatgaaaaggtgtaccaagtgaactttagaaggattggatgatttcagcttatctcttattccctgtcctataaattaataatggtatgattattctaaaaatatgatagatatgtagataagtaagaattgataaaagcataataaatatacaattgcaattcggtaaactgaagaacatacatacttcttagacattgctaaaaacaaaatcaaaaaattgtagatcatttttttcctattgttcacaaataagaatggtactatcaatgatcaatctcatttctttcttgaaattatctataaacaaaacaattttcatattggttcatcaagaaacaatactttttatatttctatattatacttacttctatgttacatgtcactatatttgattatcataatttttttttaaagaattggtcacttcacatatatgtatcagatatattggtatcagatatagatgcatgaagcaaattaaagtatcagtactttgtagcaaaacacattcttcaaatcatgacatgaggtaaaaaaaaataagatgatatttttgtaagtattggaaaaaaaaagagtaaagcttctgaaatcaaagagacactaattttccacaacatccttcaattgggcccaagcttcctttcctatggacaaataactggttgttagtgccagccttttctttttaccagttttccattgatggttaaaagctattatgaacctgtcactccttaaaatttccaccaaagtttggtaaataaatatataggagagtgaataatacaagtcttgcattctatctctaagttattaggtatatgaaacaggtatgggtatttggttttagaaggtatgtggttcatcactatttatattattactacaagaaccaggtaaactttattatggtacagtaagtttggtgtgagttgtaactacgttatatccatctcacttagcacgataattaaatttaaaagcaaaaagataagaaaaaggccaatctaacaattgttacctctcttgcatgacaaaatcagaaacaaaagtcccactctttcctccatggtgcctgtaattaacaagcacttcaaaaaccaatgttaattaattaatttccataaaaaaaaaaaggcaaaagccaatgaaatttaaggggtacaacaaagatttgtagaacgatcattaatattagtgcaacgcaccatgatgaagtgcatgacataataataatgtggaaccaatcatgataagaacagaaaataaatcaatgcaattgcatgatcagaaaataacgaggcgatatatcatgttcctattgatcagacaataggacaacgtgttaaagaaatgtgtcaagtgcaacaatgagggaacggagaagagaaggatgataaagaatgtggttatgacttctacaaagtccaattatttacttttttaattttttatattttccttttcactttcctaatagttgtcggattaaaaggagtttatggagtagattagattggttttgaaaaagagaaatatcatctgatacaatttttagttttcttaatttattgttcaattgatgtagtttaaaaagttgcactaactgaagtggaaaaggaacataggttggcataatggaatggatagcatttgatctttaataaatttttgctttgtgataggttcctaatatttaaaaagttttgtttgaaatacttatcattagtcaaaatccgttatttgctcacacgatcgttaaccagccacacagacatgtcatgtgtgatttttgtctgactgagattaggactaatgataagaaactatagtcaaaatcctttggacatcaaagaatcattcttcagcaaataacggattttgactaatgataagaaactatagtcaaaatcccttgggcatcaaaaaatcactcttcagcattcctctacgttttcacacaacccactatagtttcttctatacctttcttatggatttgtcactatgacttcgtcactcgtaaagatccaaggtgaagaggtcctcaccaacgatttttaggaccttgcaatcaattttgcattttcaaatcaaaccaagccaattcccaactcaagaaattcacatggataaggtttctaagagaacacatcaaaatagtttcatgggtagaagaaggtcaacaaaaccttaccctaaaatgtgattccgctcggtccattgaatagagcacgaaaaaatgagtgggatagcgatgtctgaacttgtcgtcgacctttcatagttgcgagctctttttgcaaacccttgctttcatggttgtctcttcttgttctcccttcttaaaggtcaccaccaacccagccatcagccaccactggtgctgccagtcgtgccactgctcgtgccagcgccagctaccaccagtaacttccttcaactctcaaacctcacttctctcccagtctctctctcacacttggccctccaacccacttgtgtgtcgtaggtgaagagaaggaaatgatgaaaacaaagaggagggttttctttggggaaggggggtccatgagtgatttttgagagaaggagatttgttgttgccatggggagccatggttcaagagaagaaaaaaagaaaatgggttagaattattgttgtgttgctgccatggggtttcaagggaggtttggggggttttggagacataatagcggtggtgtggagctagtggaggagttggttgaggactggtgggggtggtttggaggattcggggacttaatgatgtcgtttttttacttttttctataaaaaaataaaaaatcttacgtgatcggttaacgatcacatatgaagataatggatttcgactaacggtaggaacttcggacaaagctttttaaatattagggacccatcataaagcaaaaatttattagggaccaaatgtaaaaaatgagtatttatcagagaccaaaaatatatttaaaccattacctaattgcaactcactatgtgataagtttgttgacttttaaaataattattttaaagtaattcaaacaataatttataatagtgtaaaatcattttacatcatcaatacataagtattaaactcgatatctctctctatatatattttctgttcgagattgattgaaattatcttatttgcttaacatattaaaatgcgtcatttttaatgatattattggtctatagtttttatgtaatacatttaataatgtttagaaatatttgtatataaataacttttatctattatttcaccagagcctatgaaatgtaagcacaggtttgttaatgagtagcacaacatggacagtttgtcaaaggcccaatagcatctttaatgggattcttgaactcaagaactctatccactagatctactattattcttattaagagttttttaagatggagattgggttctaggaaaagaactcctattttttcaaaaatattattttttcttgtgctagtaaaatctaataatccgaattggattctactattagaataaaaaatgatagaagttcgtgcatcctatataacatcatgggactcacaaaaaataatccaagaacctaaaatggattctttgaccaaaaatgttctaagaatctcaatattttcccacttaagaaatataactatcaaatcaatataatatgaaatgagttcaatctttattgattcacttgacgcaagctatatgcacaactgacataatagattttaattctaaataacatgcaataaaaatataacaaacctgttccggaaaaagcctcctcaaaaagaagcacattcggtccccccacaatttttacaagtcggggtctttatgctgcatcaaaatattccatcatatcccgcaaatgtttcgtgctattaagtttatgttagttgtcccttcatgatgcatcaccagcatatcataaacaatcagttaatcccttattctgccgaaatagtcggattatcgtcaatcccccttaaggtggtcgtttgatcccgcttggcaaggcccaactttgaaagtgaattgacctaagcctcttttatgggcttgatgcgtgatagaagatcggaacataatccaatacattccaatctgaaccaaaacaaaacctaaaaccaaactactaactgatctataattttttatacatcataaaactaaaaaaacaaagcaaactaagcacataatcttacaatcccttctgaatttactaaaagagacacagatagttgaggtgggaaatgttgccaaaccagaaatgaattatcacgctccaaattaactttggaagccaacctgcacatacgtgtcttcatgaagagtatgctgaagctggatcctccaatcttgctccagcagtgagctgattaagttgatgagggtagcatacgtgaggatgaaacttgttggttaattacttaatttcttcctaggacgagtctaagaatcagactcaaactaatagaagcctagattcaaggcatgacagagaccataaaagatggcatggagttcagccttgagattggtagacactccacacgatcttgatttcatattttttttcttaaaataactacatacatattaagtagcatggttttaaattatgattgtgattactttaaggtgagtcataaaatctttttatatattgcagctaatcactggaaagtatggctgatgtggttacaattaggagtcttcttaaagcattaatattttttaacttaacaaatataattaaagagaagtaactaataagataatgatctaaaattcttgtattgattggaaatagcgtaaaaagatgtttcaaatataatgatacaaactctttaaatgcaaatggttacatgcacaaagcacgtgtatatatatgtattcatacatacatacatatatatatatatatatatatatatatatatatatatatatatatatatatatatatatatatatatatatatatatatacgtgtgtgtgtgtgtgtgtgtatatatagggagagagagtgtgtgtgtgtgtgtattagagagattttatggttgtagtttgtagggggagagagggggagatggttggggggggagagcgtattttttttttttttttaatgataggtttgtggggagagagaagtggagataggaagagaaagagagagaatttatttggtatggttagaggttttatatttttttcntca

SEQ ID NO: 181 - DNA, 44129 bp, Glycine max
ctaggaggatctatttctttgttgtataaaatctttgtataaccttagaaattatgaaatgtaaagtcataaaaaggaatattgatatactctatattgtttctaagttttttactatccactttgtagtagtattgaataagtaaaattctatcaaaatctttcacacaaataaaatcaggtgaaatctcaatattatgattgggcaagatttccctcatgaatgatagaatctgaattttatttgattcttgcttgctggttgattttttcttaagaatttaacaaatatatcttttatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatttgaatatatctacgtacattcatatatgtatgtatatgcaaacatatatacatctggatagagagaggatcagaatagcaggacaaagacaaacttgtatttgttgcttccatactagaattgcattttcttatatcaactgtgtggaagggaaatttattaacagcgctaagtattctcctaaccttaagcaggatctccttctggtctcttgccatctgagcttgcatgtcaatgatgaaaaacctgacaagcgagtccgcaagtgcctcaagttgttcctggtaaccaagctttgtcacattgaccaaaaaaaccaaggtgacattgaccaaaaaatagtcctgacaagatgttggtaaaaaaatataatcggttaatatcgatcacaaacatcattgactaaggttgacaaaaaaaattttaaccgacattgataaaaaaataacttcgaccaatgtcgatcaaaagaaacataaccgatttcggccaacagaaatattttatatgatagcctttagttgcaaaaagtgtgaaccagggggtattttgacagccgtaaaacatatctcatggcagtggttgttatataaggcaaaaaaccatgaactttcttctcttgctggtgtttggagccacttcaaatgtgattgatgttagagaagttaacagtggcattttttaggactgaaagttaacttaggagaaaccattttttatgtatgtaatacggtaacacatgtacctcttgcacagattggggagaaattgcaactttttttttacattttgccttaaaaaaagtgttcatatttataaaaataattttctatttaacttggatattttttcttatactactacactaaggtatatacaacctaattaaggcgtgtttcttaatttggagactggtgcttgattgattgactaccaacgaaggataatctaaaaaggagaaacaccatttataatcctcatgagtgcttatgtcccttttgccttgaggtagatgagtcggcatctcactgtttcttctcatgtcataaaattcttggtactaatttggaggcaatgttactcttggctgctggctgcatgtaaatgtggtgttgccacaatgaccagaatcacatttttggcaagattctgtattcgtaagttcaaattaagaaggaggcagatgtatggagggcggtgtgggcatcagaaattttggggtgtatggaatgctaggaatgagtgtatgctaaggaattaatggctctttcaatgctgagaaaattacgcagaatatattattctttgcacgatcgtggattaataaaagccagagtccctaattttaattattgttttacttaatgatatatggcacctggagcttgtttcatgaagagacaattttgaatgaaatgtgaagttaatttgattcggtggtagctgctcttcgagtgggatcatcccaaatgcaaccgatgtttatgtgcacgatggtgggggctggttagtgatgcgcatcaatgttgcatggctttagacatgattttaaattgcaattatgattgcgttgcttgcaacgaacctaaaaatcttacattgtggataattatggaaaaatacaaactgatgtgatcataattataattgtgatgtgattacagagtcaaaatacattagcgttatgactgcaattatggttgctgactacaatttaaaaccatgactttgggtgtaatggtccatgttcgatgctagctatctttgtcgagatagaaatataatctaaccatggaatttgctttctttctactgtcactggtgtatatgtttttggatcttaggtacttttggtaccatttaatacaaatcattttgttggaaaaaaaactacggtagcctacatgcaatatacaaaataaaattgaattactatatattatcataaatagtagagtataagaagtaaagaaaattctaaagataaacatgaatttaaaaacatatgaaactaatatatatatatatatatatatatatatataataataataataataagagattgttttaactatatatataacatatttaattagcttaatagaaatgcgaaagtacaataaaaaagcaaaaacataataggcgtgacaaatcggttgctaatatacaataaagacaacaaagtttgaaactaaaaccttatccagactatccaaataaccctaattaatcatgcaaaaattagaacagaagaaatttaataactatagcaacagtaacagcagcagctatagctaatgccgcgatcaccgaatcggaaaacttttcatcattgaagtattctatttcactaaccctaagcaagatctcaagttgatcgcgtgcaataagagctagcatttcaatattgaaaaacctctcaattgagtctgcaagatctttaattttagttatccacggtaagaattattagccacaaaattgtatttccctatttttgaacacttgtaaacaacctctttgctcttcctcaatagttgtatcagtggctcaagttcctgctgtgaacggcccaacatattcctgtacttacctatctcctgccatgtttaccgctacatattttctagaatgttatttgaatttcattaaaaatcataagaagcaagtttgaatttttcagtgaaatttttacttaggtttagttagaaaaccctatttaaaagctatattgttttgcttatcgaaacaaaaccaattagttcggtttgaatttcttagttaataaatcaattttatatgattttttatacaaaatattaaactcaatttactaaataagatttatatcaaattcatgaaggtaaaagtaatatttttatcttttaatgtaaggcttggtttcacttttgtcctttaacttttttttatttgatttatttcagttatcatttaatatttatgggttcttccttaaggaatcttgattttcctatagttttaattgttcttcggttatttattccgaaattgagaggggatcatcacctccaaagatttcctcgctcccattaacaaaaatgtctaaacaattaccttccttctaaaaaatttgtaaagtacctccactaattaaactcaacatattctcccatacttcattttctttgaaaacaatgttgtctaattcaagacgcttcgatataaaatatttagtcgctagaacgagagaaaaaaaattgaataaaaagaagggattttttttttcttcttaacgtacttcatgctacttatttgctggcaatcattattaatatatattatcttatatgagacaattttgaacatttaaatgttaattttgtaagtatcttggtagtatccttttctgataaggaatagatattattttgagattatattatgatgatgaattgtctcataaaaacacgaggcaagcacttgaaaggaacaaattctctaatttcttagtgggtagtgggagagaggaagtaaacttgcttcaataggcaaatgacgcatgacgcactctttataggagaagcaacactttctaaggtgcttaccataaaaagcattttgagaggctttgaacttgtctcgggcctcaaaatgaatttccatcaaagcttttgtggtgccttgggagtggatattgataccttgatgaattatgcaagcttgcttatttacttgagacagactatatatgcacaactgacaaaatagactttaattctaaatagcaataaaaagatatataataaacctgtttgaaaacggaggctacttcaatctagtacggtagttgacttactaagtacgaaacaacaaattaatgagactgctgactactgatttcatagaaagatttaggaagatgaggagtaagaaatgtatggtaaagcttctaggagtagaatatgttactatgtcttaaagtaaaaaaatatttatgtttaaaagatgaattatgattcataattattttaattaaatataaataataaaagttatatataatatattattggatcataatttataattttatgtttgtattttcagtcaatacatttataaaacaatttagcataacatttatgaactaaatttaaaacctttatttaatattttaagattctttcattagaaacaagttccggtataggagttggtatcctttcaaatgatataaagcaatagatttaaattttatattctattttattgtgtcaaaataatgtattaaattctttggtaagagacactataattttaagttattaagttgataattaattaaacatgattttaaatacttacatatttattcacttataactataaagatttagtaagagcataaataaaaaatgttgttataatatataattttaaatttaatataataaaaatgtgttagcaaaatagaaatataaacataaagcgtgacaacacatgtttttagttaataataataataatattaattacaaatattaaataggttttgacaaaatcatacctggcgcaaatatgcagtttagtgacggaattaatttgtgattcatgcaatacaatttgtaccaatcatcatcatcatcataatctctttttcgttttatttatcaatgttgctacttagtacgaaaattatttgcacaaaatacaaacagaatgatgctatctgttatgaaaagtaaatccacacagaattacacgaaacatagaatggacggttatgattttataaaatgaatatcgattaaatttaaatgttatggtaattttaaaatatgaatgataaaatgattcaattattatactttagtttgtaaataaaaattgatttttataatatttaaagtttataaataatattttgaataattttaaaaataaattaattaaattaaatgcaaaaaactgaaattaaatattgcttaaaactaattaattattattatatcatctgctccattataattgttgtgtaaaaaataataattctaaaataatttttatttttattttttaatgtaaaattaattatgtttttttacttatatttcttatatatgaatgatgaactacaaaatttaaaaataaattattgatgatataaagttaattttataaaattattttttatttttttatttatataaaataatgtatgatgataattattttcagaagaaaagcaacacttttctaagataaattgttatagatgtttaatattatattttgcttgtaagacaaaaacatactaactactaaattatctaatttatgtatatttttagtcctttgcataatcgggcgataacttatcatatgaaagaatactgatgatgataaatactttttgaagaataataatttttatgaaatatttgaattagttttacattaagagtttctaatgatcttaaaatgattaaatgtattatattatatttagtaatatacttaaaaatttaaatattgttgtaattttaaaatatgaaaggataaaataattgaattattttacaatggtatttcaaacaaaaataaatagttatactttttttttataatactagtatatgtataaaatagaagaagatagataaataatacaagttatatccaattactacaagtacgcaccgatcaatttcaataaaaaaaaaaaacaaggtgtgagtgaagtcaacaattaagatagaaatgaagttggaagaatcatcgattttaagattgcattatatgctaataattgggctgactatatatacccaacaattaatgttgttatcgttgttgtgcttgtctagtgaatgatggcagatgttgtatttcaaggtatgggaactgcgtggcaatttctgaacgtgattatggtcataaaagacaaagttacgttcaaaacagcattggaaaacctccaatccattctaatacgcagcttgtttctgattgttccaaagtccacagcttaaattttgtggccaggcatcgttacaatgttaaactaaaggcatttacaaagtcatttcggaatatttactccacggtcatgttagctcagattgcaagagatcaaaaagagaaccgtaggagtcaaatactacttgcctacaataatcctgctcagtctcataagattctaagtattgttgatatatattaatattaagggtctatctggataaatgtatttagaagtactactaaaaaaatccatctcaaagcagaaaacgcccttattagcttcacagcaaagacagaaatccacgtcaaaaacattaacaacgtgttttcaattgcctccccagggtcgaagcacgttttctcaacaaccctaagcaatgtctcctctgatctcttgccatctgagcttgcatgtcgatggcaaatagtttcccgagctcgtcgaaaaaccggtccagtttgtccttgtaacaagccctagtcacaaagtgtagccaccggatttttgaacactcgaaaacaagctgtgtcccctcctccatctttctgataaacgattggagttcctccttcggaagctgcaactcgttgtttttctgttctatctccttgatcaccggagatatagctactagagtggatattggaggtgcaccaaagatgatttgaagcaaaccgttttgtttttaagttccaaaacggttcccagcaactcgttgaacacagctcccactgttgcttctattagtagtgccatgatattcacaacagaaacacgcacccacaaggatgaaaacaagatgaagaaataaacctctctttataatatatagagtcaggttaaacgtaatgttaaaaaggaagtttcttggaactccatttctatcctgttgactttacgaacttgtagctaggtatacttgtttgtattatttaccgacttgaacatattttaattatttatttaattaactgaatagttataatttccttaatagatgcgagatgccaaatcttgttccaccctccaaccccaaggataattaatagttaagtgtgaaatagtatgtgtgtgtctatctatatatatattataaaattttttatacaattatctaattataacatattatttatgtgagaaatttattaattttttaaataattcaaatgataatttataatcagatgaccgtgtcaaattattttataccatcaatgaataaacattaatctctctctctctctctctctctctatatatatatataaattctaatcaaggttggttgaaattatcttacactaaaactaccattattcttattcaagagtatttcatgatgaaggttggattttaggagaaaaattcctaaaaattcctttttttttttgtgcaagtaaaatctaagaattcaaattgaattttatcattggagcaaaaaatgatagaagttgttgcattctatatagcatcatatgacccataaaaaataatccaagaatccaaaaaggattctttaaccaaagatgctctaagaatctcaatattttctcacttaagaaacataactatcaaattaatatactatgaaacgagtttaatctttagtgatttacttgagacaaactatatgcactactggcataatagactttaattctaaagaacaatacaaagacaacaaacatgttccggaaaaaagcttcctcaaaatggaggctacttcaatttagaacactcacgtgaagtgtattgtataacatgtctccttaggtcagaatgagagctttttattcgtgcttgaagcacgcccccttcaatttttacaagtcgaggtctttatgttgtatcaaaatgttcaatcatatccagctaatgttgtcgtgcaattaactttatgatagttgtcccttcatgatgactaactgtcgtaccataaacaattcattaatcccttacttttgctagcgagaaaattgttgctgcagtccactgtaatatcatttgttgcaaaaaattttgcaacgatatttaatgtcactaccactcttaacgctttcgcaacaaaaacttctactatttgataactacgaaaattaggcttaattgatagtcaaatttaactaaaaatgattagaatttctttattttattattatttttaatagaataatgaggattttaatatcattttaattcttctttcaagtttttaatttctcctcctcagtaatctagattccataagatacttcttgaagtgcagctatgatttttttttttttgtattttaccattcttttcttaaaattatcatacataattatatatgctatatacttgttgttagggaagaagataaaagttggttttcgaggatcagggcctccactgagaaaaggataagggaaggaacagttgtatattccattgattgatgctgttattacataatattatttatactgatttctcaataatcaaatttgtctttttgtgctacagaatatcagcaaatggttaagtttgtctacccctacagtacagtggcggattcaagatcctaagtcagttggtacaaattataaaaaataaaatcagtgggttcaattatataaatatagatgaaataaaatataaaaatataagattttatttacaaatttggtgaattttaaaaaatgaggggatgcaagtgcacaccctcagatggctgtaggtccgtcattgcttccagatatggtgcacctgcttgcaatccttgagctaagtgggccttgtaattgctctcttggtcttgttttctaattgcacccttttctgttgcttgcttgctgcattctcatcctctgtttctgcaactggttcctttgctacgctatcacttgtggtgccgtttttggcttttccagtcttcccaagttcccactgattcaaattccaaaagttctgcaaataaaattgaagaagaagctagaggtgggaaatacttaagtcattctcttgaaaaagttgcagcaatgatatgcaacaaaatatcactataccgagtcaaggtaattattgtgttcacatgaacatttctcccatgaaaatatatattttctgactttgtaatctctttatagtatgcatggaaaaataattttctgattttttttctctgtagtgttatatattatttttaatcacattttcttatttatttagtttgtttctgatttgacatcatgtgaatttggagatttgggttagaaatatttttggaattttcctggttagaacttgataggtccataatgaaggtatataaaaggatagggaaaagagggagagcggaatagaaaaagaaaggacaaatgggcctcaaaaacaagacatgcttgtgtatgacagcagaaagaatcagcagtacaagttgcactagctgaagtggaaaaggaacataggttgacataatggaatggatagcttgtaaggagagtgtacgtagaggctgagaataagttcttccttaagaaagggagtgggtctgggtttgttttttcctaattaccattctcaacatctggcttgtatccgccactccccttctctctgagttctatttttcatacttggaagcctattttttttaatataaatataaaattatggggatatctacctgtcaaaacttaatataatatattagtatctattatttatttattttattgattttatttagtaaaaatcacccacttttctttccgcatacatctttgacatatatgtaaggacattgaaatctttaattcattaatatatgtttttaggaataaattaacatgtgttctttctttaattctatgcgtatgggttaaccaatattcaaactctagaccatttagttaaaaaatacaagtcattactatttgtgtcaatcattattggtacactgcacaagtttaaaatctagttagatttgtaaagaaatgttatgttacatttcaaatgacttctgactttctttagtagctaaaaaacttgtttaactatttgataaacaagttttttcaataatttttaacattttttaaaacgttacttaaattaatatttttaaaaatactagtttctaacattttatatttttttcttattttatctttaatatataaacttaaatcttgaattagttagatacaagactatatccaatcccacttaactaacctcaagaaattagatgtcttatataattattaaatttatttaatacacgtctttcattttgtaatgataaaagatttactgataataatgcattccttttatagtattaattattttatttctattatgacattattttcttactctaatttttaaatatttttacttcataataaatataagaaatgtaatatcaaatattatattaaaattaaaataattttaatacgaataaaacaattaatcatatttctaatttatgcgttatgtttttaagctgaaaaataaaattaactgtaaagatttgggtttagttaaatttattcgtaattgactttagaaggagtaaattgaaatacacttttaaattaatatttgagtttctctatcaaaaaaggctatttgagttttatatttttattccgacgtcaaattctttgatatgtatagactatatttgagatacttttcgctttgaatttctatcacgctctgagaaatcaaatatatatatatttctcttgatcttaactttaaagtttaaagtgatatgagatttttacacatactaaaacaattttttctcaaataatgcatccattgatatccttgtctttgggtttggatccaagagtttcgacagcaatctgcgtacatctggtgcaatccagttaggaaatttgaactctcccctgccaatagaacatacaagatcataactccttctgtttatcacttccggagcagcataggcaggggcaccacatgtagtgtggagtaatccatttatattcccattttcatccagtagaagattttctggtttcagatcacgatggcacacacctcggctatggcagtagtcaacagcgctgatcaattgctgaaattatctcctagcatcatcctgcttgagctttcctttggataccttattgaagagctcaccaccttttacatactccataacaaagtaaattttggttttgctggccattacctcgtaaagctcaaccacatgtggatgcctggttagcctcatcgctgaaatttcgcgcttaatctgatcaatcatcccaactttcagaatcttctccttgtcagtaatcttaatggccacactcatgccagttatgatgttcctagcatggtagacttttgcaaaggttgaacaaggatagctcagatggaggcacggactcatcaacctcggtgaaggaattcttaactgtcaagcacatctttcaccattccctgattttggtgatgacactagagaacaatgaagaatatggacttcttggaaagtttgaagaataattaaggaatgatgcagcacctggttagccttccaattacccagcagcagaatatacaatgaaagacacacctgaaagaaagatgaacaaatttaataagttgggatcattgtcagagaatataatctcctgaataaaattcttgaaacttctacaaacataaccagcataacaatttttataacttgtttctgatgtcatttttgaacaatcccaaaaccataaggcattaggtgagttttgatcatatttaaacaggactggattaaaaaacaaagtatttagcacatcaattacatttctctcaggtagtctagtcgtttttagagttcttataaataaacgattcatgaccaagaagaacaacacaagactaaacaagtatgacagaaatgtaagattgtcaaaaatcaagaataaatcgaaaccagagatggccacacattatgcagaagaaataaaatttaatcaaacaatcaatcagcagatggcagaaagcacactaatacaacaaaatacatcaataatgaacttgagattcataaaaaaggagcatgcaaacaagtgagacctgcattctgttttgaattacatagacaaatcaagtcattcacactcatctgcccaaattaatcgtctaaagttgggagagtttaatgacactcgagaagaaaatgaaaattcagtaaggtttcaaataagcaagtataaatataactgagttgccaccgttttcagatgaatgtggttccactttccattacaatcgttaccgtttggcagtctatctaccaattttcatgcttgggtcacatgcactaagttattgtcaatacatattggcaacaaattaaaattttccagatgaaaaaaaaaggaaaaaatttacaaatttgccgataagagaaaaaggcaaataaacacaaacacccctctcaccaagagagagcttaactcatgaaaataacaaccatccacctataccagaatttggttttaaaatatcataattttgtactgtttatttttaaacatgttattatttgtaaaaattgaccaaaggtgcacttagatcttctcatgctacacaaaaatcaagtttaataaacattaagaaatatttgttacatttaataagggagattttcataataaaaaaaattctgaatttcaataaaaatacatttgatgatctattttttgtagtataaaatctttgtataacattagaaattatgaaatgtaaagtcataaaaaggaatattgatatactctatattgtttctaagttttttactatccactttgtagtagtattgaataagtaaaattctatcaaaatctttcacacaaataaaatcaggtgaaatctcaatattatgattgggcaagatttccctcatgaatgatagaatctgaattttatttgattcttgcttgctggttgattttttcttaagaatttaacaaatatatcttttatatatatatatatatatatatatatatatatatatatatatatatatatatatagattttaatgcattaatatacttagattagatacattaaatttcaaatttctgtaacaacctttgtgaattataaggaaagtctggtcaactaaataagctaatttacactcatgcatacaatcgcttcacttgaacttaactcaatcgtcatcatcattattatagtgagttaatagaaatgcaagattctcattactaaaaaaaaatagtcattactaaaaaaaatagtcattccataaaaaaatagctataagaggtcttgttaataaatattcttaaatactaagaaaacttaaaaatattaaataaaaatataatattagtatattaaaattgtttgaaatttaatttattattcaaacaatttgcttttttaaaaatcttaacaatttcacttgttacaatgtgacaaaacattcaaggaagaaaaaacaaagttaacttatatgtgggagtgagaaataggacaacaaatgaggctataaaagtaatatattgttgataaatagaaaaaataagttatataataaaattgtaaaacaaatttaaaacttcattcaataatattttatcatctataataattatgataattatcttaaaaatcatattaatgatgatatatgagtgaatgataatataaaattaatttatacttaatgcatgagtttaaattatagaaatattcttaaatattaaataaaaatataataatagtatattaaaattgttaaaaatactgtatagtttatcgttcaaacttttggtcctttattaaatcttagtaacagctcccttgttacaaagtgacaaaatcttttgggtatgagattggtgagaattagggacaatgaaaatgatggcatgccaaacatcgctaaattgacctaatggggttagttttacaaactaattcccagaataggtctgttttaaaactattttcaagggggtttcttttttacgtagattcagccatgcatgcatgtatatcgccagcatgcatgtatatcgtcagcatgcatggcgaaatacgcctgcactggacatgtggctattccgccagtgtcactggcgagatagctggcacagtttttgccactttgactggagatttcggtgcagagggcgcaggcaaggtgcaaagggcacaggataacagtagggcagtagggttcaggctaagttggttttgcaatcagtgttggcgaaacaaggagcatatatcgccaatggtattgacaaaataggtgtgttgtgccctttaagtagcaacttcatgttgatgctttcgtgctgatgctttgtgcctttaaaaatttctgagtgttctaagtgtttttaaagtttctctcaatcagtaatttctcttctctggcatcgtttttatttatttgaagtaattattttgagtctggaataaaatttgagtttcgactggcatcatttttatttattaatttctttggcatttttttatttatttaaagtaattattttgagtttggaataaaatttgagtttcgagtattttttgtaattagatttgtttattttgaagttattaatgttaagattaattatttataataacaacttctttaatgatttgttctgcctttaaaatgtctactttcaaaggtttccgttctgcctttaaaatttttactttcaaagcgttcaagttttttaagtttctgcatcatataattaattttttgttagaataaatttttaatctaaagtttgagtgtagtatttttttaattatatttacttattttgaagttattagttttaagattaattatttataatagcaacttagttgatggtttgatgtgcctttaaaatttctactttgaaagcgtacaagttttttaagtttttggcatgatatttatttgaagtaattaattttttattagaataaagttttaatttgaagttttagtaacaaggttttttgttattagaatacccaaaataatttaaaataacaaaacaaaaatttaaacaatatatattccaaattcatacaaactaacataccatatatttgaataataacttaaaatacctaaaataaatataacatccaaactttataatacctaaaactaaaacaaataatttaattatgaccaacagaaaaaataaaacacaaaattttttaactacattccaagtttgaaaaaaccaaatatgggcgggagaacatgcagctcacaagctttttgtcaccaccaaagcgtaacgtaacaacaccaaaccactactaaaaataaaggccttgtacatcggttataacgacctttctacatcggttatgacgcgtggtggtaacccggggtcgttgaatcacaacatcggttttatgaccgtctttgaaggccggcttttctacatcggttgtctagctacaaccgatgtagaatgggtaactttctgcagcggttctcaggctgaaacgatgttgaaagggtagatttctacatcggttatcagtcaaccgatgtagaaaatgaaaggtttctacatcagttatagttcaaccgatgtagaatgactagatatggtaacgttgctacatcggttatcaatcaatcgatgtagaaaatgaaagctttttacatcgtttatcgtaaaaccgatgtagtatggggagattttcaacattaccttgtattggaggtatattgatcctttcctttagcaataaaaaatcgaacacgatgtcccaactatacttaattattcaattcaagaacctgtgattacaacaaaaaattgattttcaggttcaagtcataacaactgagtataactaagagttttctagaacttattagtatggtactgtatgacatggatgacaggatgcgatttctcatcacagtataaactaaaaattcttatgcatgtgtagaggctaccacttaatgttttctcatatggctactacaagtcacaattttcttgtgcaatgactaaaatttaaaataggaactataaggcacaaagaaatagtttaaccaacgaatttcttgtaaacatagacaaaagtcagaatggaaggacctcaaaatgacctggcaatagcaattactaatttgataacttataatatcatacattgggtacaaaatgaaaaaataaaatgttataaacatataatataaagaaaatgataacttaatcatgtaatcattttgttttcttctaaatttcaagaaaaatattgtaagtagtattccaagtggaagcaataccaatcaagcactggacaatttgaatctctgtcaagaaaaaatgctactgtcttatggtatttcaagtagagatgacttctagcgtgtcacaggaaataaaaaccatctattacgaaagatagatgtagaaaattaaaatgaaaatagtactgtatgcatcaatcacaggaaataaaaaacaggcaagaccctcgatattgttcatctaacacgtgcaaaatatattattatactgtatgaagtattttgatctggtagtataattagggtcagtgcttgagcagttcagaacagagcgctgcagtgcaataaccaagacaacaaggactgactttttttggttgcacaataagtactgtctgacactatgattgccacaataaatagtttaagagcaaattagtaataaatgtcagtttgatttaaacaatagtattacactcctgggctcagtgggcttcatgcatcgagccaagtccagcgaacgtgtaacacgctccaaattttatttaataaatttgttactatttaatttttaagtattattttgtgcaagttgaagcttcctcagttccatagcactactatagcagcaatgcttaactagacactcagaagttaaaatagaaacctgaactattaagtaataaaaaccagttaactgttataaacaccttcagagtatatcagtatattccatatacctaggcttatttttttggaggcaagaagtttctggtactctgctgcctctgattttgctttggcaattctcttcttatctgcaatccttgccctctttctttggagggtcaggggagtgaccagccgttgtatcttaggacctttgctcacctttttccctacaaccaaacatatgcaactcagactagaaatcatcacaatcatgtccaaaaataatctccttcaatgggtcctacccatcaaacaacagcataaatatgcaaaacaaagttttcaaatttgaacgagaagtgatagatcataggagataacctcttacgatacatgtactaattttttaagattatcaaaaagaatgacctgaagaaaacacatttttatcagaagtcctatttttgctacacacacaactctgaatggataatttagataaattcttactgcaaacaaaatatatatacaggaccacagataaatttcaaaagaaattttcaaaaaccagataagctctgttaatgtggtcaccttaaaaaaaacaatccattattaaaaaaaaaaaacttacataacatcacgtaaatttatatatttcatagaatgatataattttttttgtctctatcaattatatgaagctctataagcttgttcaatggtaatagaggcaattagaaggtaagacatgcatgtgtactttgtgagaagttaaccaactaattcatttgttgtgactttgttaaaaaaaataaaaattgtgaagaacggcttctctgccaacacaaccaactttagtcaattagggtgtgttgtttggagaaaaagaggataaaagaaagtagaaatcaacaaagtgagattcacatttctacactttagttttaaatttttatctcactttaattttttttttcatttctttccactaacagacccttaaaaaattgaaaaaataatgtggacaatttagtcaactcactaacactattataagcaagtgggttttaaattttgaaaagcattacgcaataaaaaaaattaaatgttaaactacaaatcatgaacaaaatcatatatgggatttactagatgagaaaatccattgtttaatttccttgaaaaggaattattactcgggtttttttttctaagcaattaagcaaagagatatcattaataaaaaagctagaagactgtacaagatttacctaggccaagtcataagacaacatacaaagtttagaagcaaatacatcagaacataaaaaatgcagtaaaaaccaggatcatcctttaccagtaaaaaccaggttctcatccaaacttggccttgttcctctctttctcttttcgtgtacccgttgctaaccacgaagcttgatgaccatgacatgaccaaaaataaaatatatcagaaaatgataaggtcgaataatacgttaaagggcaaggtagatcagcagtcgtaaaaagtactttttttagtagtggaagtctatagttgtatacctctcagagcaaaactactttctattaccatcaagcgcttgtttctttacaaattacataactaaacttgcccctctttatattcattagtattttcaaatttcatcctttcatcttttgacttttaatgcttctttttcctgttattaacattgcttgttacatgtttttttagttaagggtagtggattgattaataagttaaatagttgaatagttactaaaaagttgtatagatactaaacttgtatagatagaacatgtatctttgggcttattttaactaattacatttagttgattttttttcttctcatttattattgtcttttttggcttaatcgtgtttgttaacagttgtggtgtgaagtattaatgaggatgggatttgaagcttctttacacggtttggttttgtattttgcagacaaattcattaccaaggcaaggaccaaacacaggtcttgcactccagctaccaaacaatgcacctgcctggcaaggtcctaacacaggacttgcaattcagccctcaatctggtgtacaaaaacttgtaatacatttttgtttccagggcgtatttcaatctgtttgtaagatttttaagatactcatatctgtcatacacaaattctcgtgtagttgtttgagtatataatgaaagtgttaaaaagtttcatctattacatatttgtattaatggagggaagaagagaattaggttttatgtataggataggataggatagaagtatatgtagaagttctttttggttttactatatcaaattagatgttttttgtgaattgtgatgaatgttgtcatgacttaaggcttaagcacagcaggattggtcaataacagtagttcattatgtggaaaaaccccgaggcttaattaccacattaacatcttattttgctcaatgtaagattcacaacattgctactccctttaagaaacatgttcatggtggcttcgctctatttccccttacattggcagactctcaaataataattcagtacattgcatcttactctagcctataattaggtatttcagcagctaaactctgaattaccacccatggtgccttcacttggttccccttacattggtgggttgacacaccaatgtatgcagtagattgcatatcataacagcagaccaataagttgattctcattcattctctattgtcatcatactgtcaatttgggtctgcaaaaatgtctacccaaatacacaaaatcttacacaattacaagcttgaggaattgacttcactaaattaaggcacccagcaaaagacaattggtgagccttccaattagagaggtgttgattcactttatttaaaataaattgaaaggaattcctctacactttttttatgaaaattgggattcccaaatactctaccaggtcatcagtatgttgatacctcattctctgccaaatagcctgctttcactgccatcccacattattagaaaaataaatacgggtattatcattactaaccttttggcttgagctcttagaaaataggtcaataatatgaaccatcatcttcacttgttcctcactagcttccgcataaaggagaaggttatcaactaacgccagatgagacaatttacgtgttcttttaactatctgaataggcttccactgttttgcatcaatagcaatttgaattaagtgaatgatgaggacatgaccaagagcaagggcaaggatccacttgaaggacttggaggacatatgacaagggctagagcaaggaaagccaaggaagctcttcaacaagtactatccatactatttgaatacaagcccaagtttcaaggagaaaagtccaaggttgtgagttgtatcatggcccaaatggaggaggactaaatggcaccactttgtctcaattttagagtgtttagtttgtctaaataatggctcaatccttgtaaagttggttgaccataaatatgttttgggttaatcaactaaaagagctttagtttggtttagttcaagttgtaataagggcccaattggcaacctaggcatcagccttttgggagaccaaatggtggctagcttgatggctgttgggggtgacttttggttgccacaattttagttacacttagccattaagttcttttaattccctaggttagtggcattaagttctttaattctaggttagtggatcattactaaaatctgatgtaaagcttttatataagctgaaccattttatcaataaacacaagttgagttttattcagaaaaatagagtttatctcttttatcttagtgagagtgattctcctaagttcttgagtgattcaagaacaccctggctatatcaaaggactttcacaatctttgtgtgtttccctcgccggaaagagtgattctttccttcctttcatcttcaaccttgttctttcaaaccacaattccaaaaaatccacttctgcccataattatctcgtggccataactcctgttttacgcgctcaaattaagtgattcttgagcctaaattgaatttcaaaacgagatctttcacctcgttttggaatcacctcatttggagccctgtatcttgagttattgccatttctatatttctgtccaaccaccacttaacctacgttttatcatctcattcttccattttatgccaagaaccaccttattaaggcccacgaaattagccaccgctcaacccttaaatcttgcaaattttccatcctttccttaatcaatttccgcattttccatcaaggtttaatcctagacaatccttagtcagcctttgtgcaatgaaggttcatatcatttggtatcagagccaagttctaggatcaacacttcctttgctggaaatattgggtaacatccttctttattctctttgccatttatattaccttcttattcatatttttttaggctgaaccattgcaaaagttaagccttttgatctctttgttatatatatattaaaaaagcagaaattcgtataagcaaaattaaaaacaaaaattgggctgaatggttcatgcctgaagaacttaaaaaatatatatatttaaggtaatatattggtagcatgaaggattgttacttgaattcctaaattctgaattttatttccttcatttgtgcctaaaaacattgttagcctttttcttggttaaccttttccttgtctctctagccttaccttacacatattggtgaattgttctttgttgtggccataatctcttgaattgcctaataactcaaggggaattagagtggtaaaaggcaagagtgtttcattagagaaaagccataattgtgtgatacacttgagtgggtgaggtattcaaacaacaactataattgtattgttatgtttgatttgtttgtttgagatgacaggaacaaatcctaatgatgaagtggggctttcgcaattccaaatgcaagctttgatgcaacatttggagaggttaatgaaacaacgagatgatgcactccatgagaggttggatcaaatggagaatagagatcataatgaagaagaaaggaggagaagagggaatgatggtgttcctagacaaaaccgaattgatggtattaaactcaacattcctcccattaaaggaaagaatgatctggaggcttacttggagtgggagataaaaatagagcatgttttctcatgcaacaactatgaggaggaccaaaaggtgaagcttgccgccacggagttttccgactatgctcttgtgtggtggaacaagcaatggttgatacatgggtggagatgaaaatgatcatgacgaagcggtatgtgccggctagttactcaagggatttgaaattcaagctccaaaaactaacccaaggcaacaagggggttggggagtatttcaagtgtcataccctaatttcgtccgggaacctttgctcgatgacatgcgaccattctttggtccttgtgaggtgcttggcacccatcattaggcaatttatgaaattccaggacatgccgaaaaaccaaaaaaaatattgatgcacaatccgtaagtttccgtgacacaccggaaatcaaaaggaagcatcgttgcataattaagtgaggttccgtaacattccgtaagtcaaaaaggggatgattatgtaatccgcaaggttccgtaacattacggaaagaaaacaagtatcgttacgaaattcgtaagtttccgtaactttacgaaaaaagaatcaccaaaaaaacagcagagggggtgtatttagtaaaaatgggggtgcaaatagcacccagacccacttgggccctccagaagattcctccagaaggcggttgcttctggaggaagcaaccctgctcgcctgggcgagctgggcggcaagcatctcccctattttgctataaataggggagaaaatgaagaagaaaaggatcccagccctttaggcacttctctctctttggaatttgcttggaaaaattgtttccgtgaagaaaatctaagccgaggcgcttccgaaacgtttccgtaacgttttccgtgaggaatctcgcaaaggtttgaaccgttcttcgacgttcttcattcgttcttcatcgttcttcgatcttcaacgggtaagtacctcgaaccaagcttttcgattcattctatgcacccgtagtggtccacattgtgtttcgtgcattttgattctcattttgtttactctttataccccctgttgacgtgcttaagccattttacttaagtcgtttctcgcttaacttaaaaataaaataaatttccaccgaacgtttgaattgtattatccattagcttcggttaaaataaattccgaccgttcggtcatgccgtaaccacgttggaaatcaaaaagaggtaaaaaataatataataatcaaaaagacatcttttagtaaaataaagcggaaaatcaatcggacgttttctctttgggatttctcattcttaaccgaattgattaataactaaagtgaaactaaggctaacatcaactcgcctagtcaagctcgtccacaaaaataagcttttgaagtttgtcatttcaatttctcactaagtaaaatggatcatttttaaggtccaacgccttaaaatgatcaccacttaagtaaaaaagaatcacttgataagaaagaactacgtaggtctgattttctcatcccaaattgaggaatacgtaggagcaaagggaaacacccttgtcgaccacaaaaaaggaaaaaatataaaaagggtataaaggatataagaacataaaagggaataaaaaaatcaaagtcatgtttgcacattcgattaaaggctgccgtcccttgggacgggcgtgtggggtgctaataccttccccgtgcgtaaatacaactcccgaacctttcaaacttaaaaattcgtagatcgcgtcttttccggtttttccgacgttttcctcaaataaacgttggtggcgactccgcacgtattcctttcgtggaacacgcatcccgcgagtcacgcgtcgccctcccgccgaagggtaggttgcgacatcaaggaaatggatgtgcttatgattcaagcaaagattgaagaagatgaggaggtaactatggctcgatttcttaatggtttgactaatgatattcgtgatattgttaagctgtaggagtttgttgaaatggatgatttgcttcacaaagcaatccaagtagagcaacaattaaaaaggaaaggagtggctaagaggagttttaccaactttggttcttctagttggaaagacaaaggtaagaaagatggggctgctacttctagtagttccacacctaccccatcaaaaactcgctcaaagtcccaagaggaaccctctaaaagaagtagagatgtgaagtgtttcaagtgccaaggcctaggacactatgcttatgagtgccctagcaaaaggtccatggttcttagagatggagaatatataagtgaatccgatgttgaagaggaagaagagagtgagtacgtagaggaagaggagactccggagggagatttgttgatgattagacggttacttggtggtcaattgaagcataaggaggagagccaaagagaaaacatatttcaaactagatgtttaatcaatggcaaggtgtgcatggtgatcattgatggaggtagttgcaccaatgtggctagtactagattagtgtcaaagctaaatttagctactaaaccacatcctaggccatacaaacttcaatggcttagtaaggatggggaggtacaagtaaggcagcaagttgaagtggatgtttccattgagaaatacaatgataaggtactttatgatgttgttcctatggaggccagtcacttacttttggggagaccatgacaatttgataaaagagccaatcatgacggttacatcaaaaagatctctttcatgcaccaagacaaaaatattgtgctcaaaccattgagtccacaagaagtgtgtgaggatcaaaagaaaatgagagaaaaacttcttcaagagaaaagagaaaaagaaaaagtgagcaaaacacttgagagtgagaaaaagagggaaacacttgagaggaaaaagagtgaacaaaagaagagtgaaacacttgaagtgagggagagctatttagccacaaaaagtgaggtcaagaggttgtttcgtgctaaatagtcactatacatcttgttttgcaaaaatcagattttaaccaataacacttttgatgattttgaagtgccttctagtgttaaaactcttttgcaggattttcaagacatgtttccatcaaatgtgacaagtggactaccacctttgaggggaattgagcatcaaattgatctcattccaggagcttctttgtccaataggccagcctatagaagtaatccacaagaaaccaaagagattcaaagacaagtggatgaactcattagcaaaggtagggtaagagatagtatgagtctttgtgttgtcccggtgattttggtccctaaaaaggatgagacatggcgcatgtgtttcgattgtagagcccttaataacatcaccattaaatataggcatcctatacctaggcttgatgatttgcttgatgaattgcatggtgcatgttacttttctaaaatcgatttaaaaagtggatacaatcaaattaggattaaagaaggggatgaatggaaaactgcttttaaaacaaaatatggtttgtatgaatggttggttatgcctttaggcctaactaacgctcctagcacttttatgagattaatgaaccatatcttgagagagttcataggaaagttcgttgtggtgtactttgatgatattcttatctatagcacttcacttgatttgcatattattcatttaaaatttgtcttgtgtgtgcttagagaagaacaattgtatgccaatcttgaaaaatgcatcttttgtactaaccatgttgtgttttttggattggttgtaagttcaaaaggagtgcaagttgatgaggagaaggttacggctattcaagaatggcctacacctaagtccgtgaccgaggtgaggagttttcatggcttaataagtttttatagacgatttgtgaaggattttagcatattggcagcatctctcaatgaagtgctcaagaaaaatgttggtttcaaatggggagagaaacaagaagaagctttcaatgttcttaagtaaaagctaactaatgcccccatacttgcattgccaaactttcaaaaatcttttgaaattgagtgtgatgcttcaaatgttgggattggggctgtgttgttgtaagaaggccatcgaattgcttattttagtgaaaagttaagtggtcctatccttaactattcaacttatgataaggagttgtatgccttagtacgggctttgaaaacatggcaacactacctttatcccaaggaatttgtcattcatagtgaccatgagtccctcaaatatatcaaggggcaaggcaagcttaacaaaaggcatgtgaagtgggtggaattcctagagcaattcccttatgttatcaaacataaaaagggaaaaggtaatattgtagccgatgctctttctcggcgtcatgcattactttctatgcttgaaacataattgattggtcttgaatgtttgaaaagcatgtatgaaaatgatgaaacttttggagaaatttttaaaaattgtgaaaatttttcagaaaatggttactttagacatgaaggctttcttttcaaagaaaacaaattgtgtgtgcctaaatgttctacaagaaatttgcttgtttgtgaagcacatgaatgaggtttaatggggcattttggggtccaaaagactctagaaacattacaagaacatttttataggcctcatatgaaaaaggatgtgcataaattttgtgaacattgcattgtatgtaaaaaggcaaagtctaaggtaaagcctcatggattgtatactccattgccaattccggagtatccttggattgatttatccatggattttgttttggggctgccaaaaacaagcagtggtagagattccatttttgtggttgttgataggttttctaaaatgggtcattttattccatgtaaaaaagttgatgatgcttcccatgtggctgatttgtttttcaaggagattttgagactccatggtttgccaaggagcattgttagtgatagggactctaagttcctaagccatttttggaggactttgtggggcaagttggacactaaattgttattttcaaccacttgtcacccacaaaccgatgggcaaacggaagttgttaataggacattgggaactttgcttaggacagttttgaggaagaacttaaaaacttaggaagcttgtttaccccatgttgagttcgcttacaatggagttgttcatagcaccactaattgttctctttttgaagttgtttatggttttaacccactaactcctcttgatcttttgcctatgcataatgtttctgtttttaagcataaagaaggtcaagcaaaggcggactatgtgaagaagcttcatgagagagtcaaaaatcaaattgagaggagaaataaaagctatgctaaacaagcaaacaaagggagaaagaaggttgtcttcgaacccagagattgggtttgggtgcacatgagaaaagaaaggttttcggaacaaaggaaatcaaagcttcaaccaaggggagatggaccatttcaagtgcttgaaagaatcaatgacaatgcttacaaagttgagctgcccggtgagtataattttagttccaccttcaatgtctctgacttatctctttttgatgcagatggagaatccgatttgaggacaaatccttctaaagagggagagaatgatgagggcatgaccaagagcgagggcaaggatccacttgaaggacttggatgacctatgacaagggctagagcaaggaaagccaaggaagctcttcaacaagtgttgtccatactatttgaatacaagcccaagtttcaaggagaaaagtccaaggttgtgagttgtatcatagcccaaatggaggaggactaaatggcaccactttgtctcaattttagagtgtttagtttgtctaaataatggctcaatccttgtaaagttggctgaccataaatatgttttgggttaatcaactaaaaggactttagtttggtttagttcaagttgtaataagggcccaattggcaacctaggcatcagccttttaggagaccaaatggtggctggcttgatggctgttaggggtgacttttggttgccacaattttagttacatttagccattaagttcttttaattccataggttagtggcattaagttcttcaattataggttagtggatcattactaaaatctgatgtaaagcttctatataagctgaaccattttatcaataaacacaagtttagttttattcagaaaattaaagtttatctcttttatcttagtgagagtgattctcctaagttcttgagtgattcaagaacaccctggctatatcaaaggactttcacaatctttgtgtgttgccctcgccggaaagagtgattctttccttcctttcatcttcaaccttgttctttcaaaccacaattccagaaaatccacttctgcccataattatctcgtggccataactcctgttttacgcgctcaaattaagtgattcttgagcctaaattgaatttcaaaacgagatctttcacctcgttttggaatcacctcatttggagccctgtatcttgagttattgccatttctatatttctgtccaaccaccacttaacctacgttttatcatctcattcttccattttatgccaagaatcaccttattaaggccaatgaaattagccactgctcaacccttaaatcttgccaattttccatcctttccttaatcaatttccgcattttccatcaaggtttaatcctagacgatcctaagtcttcctctgtgcaatgaaggttcatatcaatgaaatagcctctcaatgcataaaacaaaaaggtaaggagagatgggatctccctgtctaacccctttttctagtctaaactcctctagaggttcactattccaaaacatacgtatcttggatgaagagatgaaatgccaaataatgttcacaaagttctttgggtacccaatatcctgtaaagcatctcgaataaatgcccaattcaagcaatcataagctttctccagatcaatttttattgacatccatccatttgtagttttttgtgtctcattgaatgaaaaacctcttgggaaataattacattatctctactctgatggatgggaataaagttgacttgacaagggccaagtaatttctccatcaagggccttatacaatgagaaagaactttagtgatagctttgtggaaaacattacataagctaatcagtctgaaatccttcaatctagtcatatgtttcaccttggggataagagtgatatgtgtatcattaatctgatgcaccaattacagatcctgaaacacgctttgaaccaacttgacaagagcatcccccgctgtattccattgactttaataaaaaaaactgcatggaagccatcagggctaggagccttaaatgctcccatattcctaataatgttaagaactttttgtgaagacacatcaactccaagggaaaaaacaaattcctcatcaattagaggaaacatacttgttacagggaactcatcaacacactgatcatcaacaaataggttctggtaatattgagtcaccatacttttcaaagattccccatccgaaacccaggtaccatcttctccctgaagagtctcaactctactccttctcctcataataatagtagttccatggaagtaacttgagttatgatcccccaatgagagccatttggaataagctttctagaaccacaaaatctcttcctgtagcatcacaacctcatattccctccacacagaatacaacatatatgcctgggtggacttatccctctcacccatccacttgttaattctatccatccgcctgagaaggcttcatttcttagagaaaaaaaattcctaaacacatttttattccaatcttgcacatctttttgaaacaaacataacatatcaaaccaagacaaaaaagagttccaatgggaatgcacaaacctcttgaaatcatcatgagtaatccatgcagcctaaaaggtcttgtttgagagtgatgattcctttccacctctaatctaaccaaaaggggtctatgatccaatttaaaagggggaagatgcagcatcacagcctcttggaattttattctccactgcaagttaatcaagagcctatccaacctctgttcaaggttgcctcttttccaagtatatggttacctttgaaacccatcatatattaattcacagtttgaaatcatctattgaaagcttgtaagatcacaaagagatggattgtcagcacctccaaccctttcatgtggatgaagaatggaattgaaatcaccaatgataggctatgacttatcaatctcacaagctaactctctcaacacatcccacataccctgcctgcactagtaatgagaactattataaaccaccattaataaccaatcattagaactcttccaactaaccttcagatgcacatggtatctagaatttcccagcatctgaaccttccataagcttgaatcccacaagcagcaaataccactagagtggcccacaacttcttccacaacccaatccttggataattttcgtggcccttgcaccactagagtgggtctccataaaaaatattaaagaggatggatattcccttttgatatctttaattaaagaagcaaaaactctattggacatactgtgacaattgcaagacaaaaaattcatggaggcatagcaacatggatggccttaacatggccttggctaccctcttggcaaactaccatatcatcattctcatttttgaaactagcattactacgaccacctttaatttgtgcctcaccaacaatgcttgggtcagttggcacaacttccttttgcctctaacgctaaagactgctttctatagagccttaatcattttaagctcttagtccctatcaataatccttccctgtggtggttaagaaggttcttgactcactaagcttaaaacctgttttcccttcttagaggccttccctttattggcaattcccattttagtatttccctttatttgcttttctttcggcttccttaaaactgggcctgtgtttttagttggcccagttttaccctcttctaccacatagttcgtcttcatctccttaaaaacaactcccctattctgtttctgaacaccctttgggccactagtgctaggcccattagcattacgcttaactctagagaccaacctttcctcacgtgcttcattaagagcaatgaattttgacccaaatgatttgttgttgcgatcctcacatccctgtgctacaatcttggtatgattggcaaggccaaccccattaaagagaacttttaactaattcttcctcacactcctacgcactaattaccaaggcccgaaatgattggcattatcattactcaaaacattcacttgattttcgttttcaaatctggaccattaatattattcattacgccattatcatgcacacgccaccctgtcaactatctccaccttagccaccatatatctccaccagttttttcgtccctcggcttttgttgggattggatatccacaacatcggctttcatctccacagagtttgcatccttgtacccatacctcccacaattaaaatagatcaaatgcaatccttcatattgtagatttaataagtaacctctagcaataatcttaggctgcaaaggtttgaatagatcaatctcaacacagattcttgtgaaacaaccccttgcttggatagtcatcactctgtcgattttaagcattactccaggagtagaccctaatctccataagaattggtcgttgaacaattcaataggaaattttgggaaccttatccacaaccatcctccttccgacatgcagattacccaagaggaaaggacgccatctttacaccagaatataatgatcaaccaccatccatgccgccccccccccccccccatgaaagcatggttgtaatcctcacctcatcagatgtgaacaaaatctaatagtagtttcttggcacatcaatgatcaatgatcttgatagcaccattctttgcccactcacaattaaacttggcctcctattgctgaaaacccaatctcttccccatcaccatgaccatcaaggacccccttccatggcttacaccagtcactaaactccttatcggaaataggaacttctgggaaacgttcaaagtcctccttagatattggcgtaggaggtattttctgatctagatacccaaaacatctcccatcaaaagttgaaaaagccattggaccaccattcttcaaaagcttctctctatacgtaccatctggcacaccttgctcggcctccttatctttatcaagctccatctccgaattaccatcaccttcctcattaggcttcctattgactttcctagtactacgctggatatcatcttcctccttagaggattcagaagaaaccctagtagaactctcaacaccctcgattacaaattatttatccctagtgggttcctgatggacattaacatagctattcatttataagttacacttacatatatttgcaaggcatccatgaatatctatggatatttcctaaaacttaaaatataaaaataaaaataagcaactaaattattttatgagctctgcacaaataggcgctgcaaatatcactataaaatgataaattaaagagttggggaaaataatcactttcacaatttttttaattattcttctattttttttcctaaaaaatagtttaaaaacccacaaatttacattccttttctcccatataagataaatgtataagatttgtcatatttctggaaaaaaatgaaattattcaaattatctaaaaatttctctctttaaagtataaattcaaataaaactacacgtcgaaacatcaattatttataagtatatccatattaattatttataagtaaatgcactttagtggtagctggtatctatgagtatatggatagtataaaatccgttcccgttccatttacaaataggttaagaaaaaaacctatttcaattaattataaatactcatttaaatattcatttttccgtgacaaattttacctgtgagtattcacgggtacaagttttgaagtccttgcattggtttgcatcttttacacgtttttttctttcacaaaaaaggtatttttttaatacacatcttttacaagtatttaaggattcgtatcagtttttgtcatagtagtaactatttagtatcttttttcatttaagctgtcctctgcttattcatgataatgacggctaactgttaagtttcttcttgtatctgtttttattttattttttctgactttgcccaacggtttatgattgccgagctgctattggttccactaagcttgaccctgtaggaaatattttcctttttgctaatttggaattatgactattggtccaaacatggagataagatcattgcatttatccattttattgagattaattaagtctaaacataagttgaaatctgcccatgcaaccaacgtcctttcatttttaaataatgacataatatgtgtcaccgtcgttgctctcaaattcaattaactcaattgagtgaataaccaaacaactcgactggtaacagtaacatcagctatgtttcaatttcaaagccttctattctttcgaaatcgtatatatattatgttcgcctattttatcacgacaaccttatgcagagggtttattttgtgatgtacggaaaaaaaaattatttattccatgactttaaaataattattattttagattattttatataaataaaaattaataaatagatgaaataaaataataatttcataaaattcggtatcttaatattaataattactttaaaaaattaaatatgatatttattttgagataaatttattttcaaatataatacttattttaagaaaaaaatacctattaattatttcccacacagaaagaagcagacaaaagtgttcaaacgatgcatacatgtggctggaaataaaatataaatagggttatttaaacaactctttttctatgcttttgattattgattagtttcgcaccatttctggcttcagatgatacttggggtgtagatataaggggaaaataaattgggttgattaggtctaaatatgtattatcaggtttcaaattatagttggtttcgttcggtttttttgggtacatggcttgtttcagtttaaatctgaatatattaaaaagattaaaataaattaattaatttgatttaacattttgatttcgtagaactaaactaaattaatgaacaacctaactttcaattagggtatctttatgcaggacggaacgataaaaaaaaaaatcgaggaggggcaaaaatttaaaagcaaccataattaacttttactatcaataattattttaaactttctttgaaagaataattatttaaaacttagtctattgaaaaaactaaaatatcatatatcccattgttatattttaattgtaaaataaaatatagtgaaatagaatggtgtctaaataagttactatttcattgtttaaatatttttatgatgaaatgaaaaaaaagagtatttctatctcatcattctttaattaaaggaaaacatataaatgtaaaataaaataaatatattttatttcattccatttaaacaatacagtttattttttattatcgtcttattttaatgttattttgaataattaaataataaagtttgatatcattttattttattgcgcttcattctatctttctttctttttaatcaaattaatcacaagactatgggaccacttcctttttccttaattttcaatttttgcatgcacttttacagtatgaaaggcataagagagagattggggagctgcagctccctgttggaccattccatcaatcttcaaatgtggaaaaagaggtttgtataatgttctttcttcccatttttatttgtagattccatgctcacatgaagattacttttattatatctattgttttcctttgtcatttgaacttgaatgaagctccttctttcttttttttttttttttgtgcacacaccactgcaagaaaacagaggcacccagatataactatgttgctgctacgactggagtttgagttcttcattttttttttagataatttttttgtttttatctctagttactgaaattatccgagagtcttcattatatactgttggagtttgagtccttcattattaaaataaattcttggattgtaagtgatgataggataaattgtagccacaccattattttattctcttctaagcaaccacacgagatgggtttcatttccgaattttgaccctcccatgtattaataagttactcttgacaagttgttcgtatataaatctactttgattacttaaactagggagttgataacatatagatctactttaattacttaagctagggagtagacactagttattttttctttctttccatcaatcgtcaatgttttggcttaaggctaccagagataaaaaaaaaaaaatgacagaatcgaaataaataaataaaattaagcaacaacaaaaaaaaaaagagataatacgatggttcttaaataaccgtcttagaatgtcttactttctaagccggttatttaggaaccatctaaaatgtcgcatgttgatcaaaacatactaggacggttattgaataatcgtcttagaaagtaagacattctacgacggtacctaagaaatagtcttagaatgtcttactttctaagacggttattcagtaaccgtcttagatccgacgacatactaagacgggttgttactctaaaccgccttcgaaaatggatcattctaagacggctgtttactaaccgtcttagaaatctatattttctaagatggttgaaaaaccgttgttataaatatgatgctattttatgatgttgtattctatgacagttcaaaaccgtcatagaatgacaaatttaaccgacttagaatatcatatttgtagtggtgttaggctaatatttcgaatgatgctacttgttttccattgtccaacataaaaaaaaaaacccaaacgttagtaatataggaaagaaaaaattaagaatcaaggatcaataataacaccacgagtcaagacattttcatgattttatttgtgtatttttttatgattatccaactgaaaatattaagcaatactaagaaatatctggcaaagcttcttagtatataatatgaatgacattgaattataagcaatttaataagcctttgcctgagcctttttcatcttccaagactcggttggattctgacttgtagaacatggaaagaagaagggttcttggaatcattggactttgagaatgtggagacatgagaagcatcaaaggaggatcaagaagaatagattgtcgatctttcccaacttttcataggtaacaagttagcatccggtggtcatagtattaagctcttacactctatagtactggactcaattgtgagcctgtatacaaacacattagatggtttgtttgtttagctttatggctttttgtttgtgtaggaaaacacgaattcaactgttttgagttcaaaactctaatatgcctttccttgttttattttgcttatggtttttacttttttctttttatatactcactgccactttagtgttttgatgaaggatagcatttggtttgagcttgaatatacaatataaataatcaataatttttttttgttgtttataataattttatcatgttcaattagaattgtcttcccatgatatggtcagggagcagaaggtgaacttctgaaatctcaaataataaatagccttacaagacaccaacttgaactatttttttttctttccttttgatttttgtcgtgtatttatacggagtacaacacatataatactatatatattatatgcatatatgtgtgtgtggtcatacttgtcagttgcatttattatcttgaactgcaggtgtgtgtgtatttccatatatatgaatacgaatgggtcttaatttacactttattgcagcttgtaaaaagctgtgggtgtactgtatcataacaaaatacatgtcacaaggaactctgaggatatatgtatccgaacaagaaagagttgtactctctttcaatagaaactatactaatgttagctcttgacatacttaggggttatggagtatacaagaacaaagcaacatgagtttttaagaataaatctccattgacttagtaatgccacaacacttaaagagtgtctacctaaatttgatgttcttgtttctacaacttgtaagatgtcatctcattactttcaaaactgtcacttataaaccaatgtcaaaaaaaatatatcattgtatagtatatcgctggagcgtgcataacatcaaaagggactgagttcttggtgaggaactctggacaaatgattaacagaccacagagatttatgttggcttcccaaatttgctgaagctttcagagatgccaatttctggaggtggctaaacaactagttgaatgacgacattaaaacaaatcaagcagtagtatcaattgtagctcattatttggtaagcacagaccaaaatcatagcacctatcaaacccaaatctgaaaaaatgtagcatttgtacaagacattatacaatgctactactatgtatgtttatcattttcactctgaattatatttagcagtaagtcacatggatttggtaaaaaaataagggggaaaatgtaacgtgtgtgtaacagcatgactttgatatttacccaattttatatttttccctccagcaataatccccagagacaaaacttcaaaaatatttcagtatgaaattgcaataatgaagatcaattattgttagtggataaaaaaaaaagtgggtcccacactaattttaaaattatccacacaaaaggaaaaacatgttatttatcacattctatttttttcttctcccttccttgtatttttcagctgaaacaaacacaatgttacatctttgtacaatttcacttttcctcttgtcaagattaaagtctaggaatgctcatgagtcagttggatgagacatgataagttaaagttgagaatttacagctttgtacattgtcacttttcctcctgtcatgattaaagtctaggaatgctcacgagtggattgttggatgagacttggtaagtaaagttgagaagaacattcgaatgtctggtacaatgcaggaaatcatgcgataatacccgcaaattgaaaagttggcgacataaatatgattgaatgctcccagccacagataacaacagtaaaccattaaagtactattcgggcggtaaaaatttaacatgccatggtttcgacctcagtttaaaaaaattcttcagcataaacagtatacatgcatgttttaatgtagtaacatttgaattcttcgacatctggtaaactgttttaacattttccacatatatatcccacaagaataggttggtgagccattggataaaattaagccattgaaaagctttctacaaaagaaaaagaaataaaaatagaagcttttatctacctgagcaatagcttcttcacaaatactcttaaggccatccagatgatactcatatgtagcccttgagaggtcctaagcaacatccaaattaaaatatcaacaattcaatttcaaagacaaaaggtattatactagtttaaataatgcaactatgaaaatgtagaacagacggttcaatgaataaggaaaataaatcaaaataaacaaacgggaaaagcacacatatgagtaaaagtacctggggagttggtaatggaaaagcatcaaaaggagagactaaacaacttgctttggcagccaatttgtgaagtgctgctgaagcatcacccttctcctttacgcccttctcgcttgaagatttaagaatatccaatagcaattctaatcatgtacatttagcagcatattcattgcaaaatacttttaccatcatgaggagaagaaaaaagtttaaaatcatttattatgaaagaacatccaaacgttacaaatcatttattaccactattgtcaatgaatatagttttaccatcatgaggagaacataaataaacaagagcaatagttacacgtatttgaagccctttttctaaaaagcacataacagagattaggtgttccaatacctgccaaagaggaatagatacaaaaatcatatccaataacgtaaaaaaacatgaaaaaaatatcgttcaaaaactataagtagattataattctcaatttcacatctataactaaactaaatcactcacagaatttgcacgaaaactcactcgcccttgaatcttcttctctaatctttttaatgtgtttgctatgcaatctttcataggctgcaagttaaacgacaatcacaacaaggtgttctgttaaggaacattaataatgactaaattataatttaagaagaaatgcaactatatatggtaaaaatgaaaatctattactttaattacaaagagtagatgaacatacaactaatctttaaaatgtccatccttcggtttttgaaaaccaccagccataataatatctacaacaatgtcctataatacaaagatgttacatcagtggccgcatatcacattatcactgcacatcgatgatttctaaagggcagcacacaatgctgacaaagtaaagaacaaggaaattaacttcacctcattaccagcaagaccatagagggctaaagtagcatcacgttgaaggggagaattgtttgagtcaataatattgggcaaaggctctatagctccattttaagcaataacagctacgtgggtcctgaaatttgaattatatatgcaaaaaagggttatggaaggaaaaattataagaggaaaaaccaacatatatatatatatatatatataattcgtgaaacaaaggagcatattttttttacaccatttgtatacatttacctataaattaagaaaaatccacccttaagagttaggtttaagaaaggcaatcccaaattcagccataactaatgactgtagtgttagaggaatcctaaagcctacaccatggagtccccattcaacattaaccatttgtaagattgtgtagttatattatgaacacagccaaaggatggcaataaacatgttaataattgaatagagactatgattagcaatctatacctaagaatagcatcatggcttatcaaatattaactttaaataggagattatttgagaattttagatcaggctaattaattactgctatgataataaaaaatgcaatttgaatttttaaattttatattccttaacatataagcaagcgactaactttttgttgctactaataatcacctgtgccaacctcccaattgcaaaagccgacatttcccggagctctacatgtggagacttaagcatgtaaactaatggtggaatagcccctccttgggaaatatggaactaccacaaagtatggaagtcaataagaggatttcataactcatagatttatcatattacaagtttgcaatgcagaacttaatccacctttaaatctgaatttgttgcagcaaattgaccaagtaaaagggctgcttgttttttgcttttcaaacaacaagaactatcattgaaattatgaacttgcaaagaatacttgggggagaaaataactaaaccattaatatgaaggtagtatctgattttcagtaaacaactataatgttcaataaacatatcattcttctatatatggattgcttaatgattaaaggaaaaaccatgaccaaagtatagtgtaacctaagtaaacaaacgacaggtggtaaagccccggctagaagcacttctttcataatatctggtgacgagtggaccaaattttcaataacaacaacctacaaaaggcgctaatacaactagtgctagtagtttagaactctgtagaagcaaactaaaaaatgcatgcgattgtgtaaagtcatataagcatcttaccactacataacgtattataggatcctctgattgaagcattagtacaagagtgggtaatgcattgcatccaacaacctgcaatttttttattgcagaaagtcaactacctttgtggcattgaattcaagcaattcaacaagaggagggatatcaccttccttccagcatataccatacctatataagcataaagaatagaatagttgtagaataaatatttttaagccatgaaaaaaaggacaaaatcctgacacgggtcttattggtggtattttcaaagtcaagattgcatattgcatcagctactctcctgagaagaccgataactggaggagaaatggtactgatcttgtgcttacttaacaaatctacaagacaaggcaaggctccaacatctataatgagttgttgacgctctggttgtttgatgataaagataagaaaaaattaaaatcagagttaagatgctccatgattacgagggataaacaaacgtgacttgaaactgattttattcttaaacatatttttggaaccctcgtaccagaaattcaaagacacccataatcattttcctctaaaaaagggccacactattatatactactgaaaactcaaatagaaaacacatagagacgttacatgcacgcagtatggttgatgtatttaatccaatacacccatattcttcacttatatgttaatttggatagtaatttgtattattatttattcaaaaatcacccttaaaattatcaagactctccatctcactttttcatttaattaattaatgtgtgctagtcatgttattggatgcatccaagatttcatgggccgataacaaaaaaaataatttgtacccttttatatttaagtatttgaaaatataaagatatattatttaaaaaaagtggatacatagtttgattaaaaattacatttttttacattaaacaaataacataggtttaatgaaactcaaaatgatatatatatatatatatatatatatatatatatatatatatatatatatatatatatatatatatatatatatatatatatatatatatatatatatatatatatatatatatatatatatatatatatatatatacctatagatatccagatatatctgtatctccccctccctccctatccatttttctatatccacccttccccccgcccttttttcccccccttttcccccttcccccttctcgccccctctccacgtgtagggacccacctagatccagttatgctctagcaccccccctccctgcgtcttccatcctttttccagcgcctttcctcttttcccccctttcccccagctcccacatgcacccccaggggcggccctgtctctcccccgcaacttcccctcatttctcgcccctactctcgccccgccctggcgacgcccccctccccacccctcgccacaccctctccgctgtccgcgacgttctcctaccccttctcgcccgctggggtgtagacacctcctctccccccccctcgttgcctctctttcccgcgcgcggctgtctttctcctatctgacctcacacgctttcccgcaggggtctttccttttgttctcgcccgaggccccctggccgtaatccatgtgccgcctaaatccccgtttgttgcgcccacgctactccttgttgctcccccctgataactgttcccccccttgccgcgcggcgtattattacaattcttatgtcgtcttgtctttctcttttctcgtccccgccctttagtgtcggctagttggcccgcttttttcttcctctctccccc

SEQ ID NO: 182 - DNA, 72241 bp, Glycine max
  misc_feature (72089)..(72089): n is a, c, g, or t
  misc_feature (72174)..(72174): n is a, c, g, or t
  misc_feature (72224)..(72224): n is a, c, g, or t
atttaggtgacactatagaatactcaagcttagccctagaggggatggacctttccaggttttggagaggatcaataacaatgcctataggttggacctcctagaagagtatggagtcaacaccacttttaacatttttgatttaattccttttgaaggtggagctgatattgaggaggaggaactaacagatttaaggtcaaatcctcttcaagggggagggaatgatgcaatcctccctaggaagggaccagtcactagagccatgagcaagaggctccaagaggattgggctagagctgctgaagaaggccctagggttctcatgaaccttaaggtagatttctgagcccatgggccaaggttgggtccaattatctttgtacatattagattaggatgtcattatacttggtccttgtatttagggctccataatgtaggtaggataccctagaaatataggatttttcaacccttgtattttatggcacctagactagtttttgtattatgggtagttttgtaatttcacattcactaagtgaatatttgatgtgtgtgttgagaaataaatttaattgaattggtagaagcccaatccaattaaattttagagggggaggtgagcatttgcttactacaccccattgccacatcatatagtcatactttgtgcatgtccttcatgctttacatgcctcatgacacctaagcacaattagtggcgaatcttggaattgatcttggattagtgggctgaaccataactgcaattcactaattataattagtgaagttttggctccaaaatttggctccataaattcaagtgaaatttgaatttccctccaattttgtgtgacacttgggctataaatagaggtcatgtgtgtgcatttttttaactttgatcatttgaaaattaaacttcagatttcagagctcttttagagcacaaaaattttgtgctcttctcttcctctcccttcattcatctctttcttcctccaagctcttatccatggcctcctatggttgtgagcttcttctagactcatcttctccttgaagtggcatcttctttctcttttccttctccattccgctgtcattcatcttcctaggcctacaagctccaatggagcttacatcattatataaagaaggaacaagaacaaaatagatttaatatgtttcaagaatctgcaatgaataaaatcaaagaaaagaaatttcacacactaacagaatcgtaatttatatataattaaattaataacaagtaatgactaatccaatttagtcaatgaccaatcaatacatctataaatacaactactaattctaatcttggagcctacactaatacaaagatagtgtaaattaaaagtctgaattaaattggtaaaaacaaaatttttcattaaaagatgggtgtaagagtttttactcgcttaaattgacggttacacaaccatctttatttttaaaaaacaagaaacaatattcctaataaagaaaaaagtcgcttagcatcaataagatcccacaattgaatccaatatataaaaatgcaaatacaaggtgattattaacttgggcctgagacccacaacaactaaattaacctataactcaaaccccacaatattaatccattatgtacccaaactacctttgagtccatcggtaagcaaaaaaaaaaacaaacaaggatcattcacagcttaatttaaacttagattgagaagttcacatgaattatcaagttgggcttaaaaccccacgagtacaaaaaaaaaaccaaacccaatgaacacattttccacccacgaagacaatacaaaggtactacacattgataccaatcatccccaagcttagtattcccgaactatggatatgatatgacagagatacaaaatttgtgattaagattaaagaatcataagattcagcttcttcaactagcttagcttaaaacctttttggaccatgtttcgtgttaggaatagagagcacactttcagtacgaatatgagtcagttaatacaccaaacatcgcacattttcaagaacaaagagcacattttagacatgaagcaaaagcatttctcaatgaacacattttcaggtactaacctggggaggaagtcacgagggaattggacatgaaaccaaagaaggcttcaagtcgcaaggtagagataatacaaaacaatgacgaggtcgcagcaaaacatgggtgaggcagtgacggtgttacagtagaacgcgggagcacctttgtaatgacccgcctcgtcgttacgatatcaccactctaataactgaaaaattaaattctttttctttcttttatgaaaactccattatttttacttatgaaaatcatagtaaatttgaatttcacaaatatatatatatatatatatatatatatatatatatatatatatatatatatatatatatatatatatatattgtccccaaacacgcaccaatgtttgaccgaatacatgaatattatgtcattcatccacaatagatatatcgcatcccattcgttaaaaacatagtttttcttgaaagaaaatcagcatgcaatagggacatgcagatattctcagagctaggttccctgaccctaactatggtgtcaaaatagtaaattttataataactcccctcacctatcgtgagctctccgtcagtttctctttgcatcacttagaggtctctctctcgttcacgcttgtcagtccaacgcaagtctctattacaccaaaacaaaaggaatttagcataggcttcaaaaacaagatcaaaggaaacattcggggtcaaataccactgtcaaaacataagggatagaggggtatttcgggttctacagaaaagaaacatctttttgaaattccgatcacgccaatgtgaccggggtttagtgaatgccgcaaaaataacctcaaggtcataaaaagataacttttacaatgtctcattctctaggatttttcaaaggaagtgtaaaaacaccctataacagtacccaacacataagagacactaagaggaactcaaactagctaggagaaggcttagaagtcaaggttaccttagagaaactttgaaatggaggattgagggattttctccaccgaattctgaggattctgctctgattaaagtgttcctcttggtgtgggggtccaacggcaagcaacagcggctcatagcggccactggtggtcttgggtggtggaaaataaggttttagggtttgggagacgtttttgggggaagaggtgagtgaaattgtgtttttcacgctaaggacgtatttataacctgcaacatttgcttagcgggccttctgggcgctcagtgcacttcctctcggttggaaatgggcttagtgcagctttgggccgctcagcacaattcccctcggttggaattgcgcttagcgtgcctttctcgcttagcgggagactaaaagttattattttcaagatcccaacggtcagacagtaggaacatatcttagggatatccagacaaaatttgaagatgatgcaacagttaacgaatctggtgtcgcgatttcattgaactaggttttggtaaaatctaaaatctcatactttcaacttagctcaacaaaactccacataattcaacatccatatcaagaaattcacacatgactagttcaaggcatacttcaactcattcaagtctatcatgtagtcaaataacacaacaaaataatcaaacatcaaatataattactaataatatatatatcagggtgttacaaccttcgcgagtgatggtggtgagactgagcacgaggaccttcgcgaaggagaggactgtcacgagggtgagagtgagagctctggtgaagggtgagagtgagagcgagactgaagcgccatggacagagagagtgagagtgagaagcacgaaagaaaattataaataggatagcacaacgttggttttttccaaaaatcaatgttaacgcgttttgttaacaacaatttttcaaaaaaaatgatgttaacaaaagttcattaacattgatttctaaaaaactgatgttaacgaactcacatcggtttttgaaaaaaccgatgtcaacgaattcatgttatttatgattatgccatcgtgttttcattaacatcgattgtatcgaaaaatgatgttagcctagcgattttaaaagtatattttctagtagtgggagtagacaatggccatgaaatacctttccgacatttttgttagaagcagcgagtgacaacatcgtgcacatgggaaacctagatctattttttgaagatatcataataccgaccattgtttcttctttgtgacacccctatttatccttcataggcgaatgttgatggtgttggatcgagtggcctcagaataattaagaagggagggttgaattaattattcctaaaactttaccaattaaaaattactcttttaaggcttttacttttgttgttaagagaatatggagtagaagagaaacttaacagaaagtaaaagcgaaaattaaatgcacaacggaaagtaaaagagtagggaagaaggaaacaaacacacaagagtttttatactggttcggcaacaacccgtgcctacctccagtcctcaagcgacctggggtccttgagatttctttcaaccttgtaaaaatccttttacaagcaaagatccacaagggatgtaccctcccttgttctctttgaaaccctagtggatgtaccctccactagaactaatccacaagagatgtaccctctcttgttctcagtcaaacccaagtagatgtaccctctacttgtaccacaaaggatgtaccctccaatgtgttaagacaaagatctcaggctgttaaacctttgatactttgtgaatggggatacaaaagaattctcaggcggttaaacctttgaacgcttttgtattagggaatgggaagaatcaaaagaattctcagactgtgtcattttgaattctttgacaagggagaagggagacacaaaagaattcaggcggttagtccttttttctttaggaaaagggagaagagagacacaaaaagaattcaggcgattaatccttggcgaatggcaaagggagaagagaatgaaaaggatgaatagcacaggttttcaaggtttagaaaaccaaaaaacttcagaaagcttttggtacaaagaagaagaagaagttcaaagagattcaaggcttgtaaaggattgtatgaataattgttcaagattgttgttggaaagattgattcggaatgcaaaacaaagccttgcttttataaactcttgatgtctggtcaagaaggccattcagaagagttataactttttagaaaaacttaaaacccatttgaaaaagtcaaaacctttttgaagagttacatctttagatttttcaaaaacaaacactggtaatcgattaccaaatatgtgtaatcgattacacaaagcttttgagtgaaacaatgtgactcttcacttttaaatttgaatttcaacgttcaaggacactggtaatcgattaccaaaacattgtaatcgattacagccttttgaaaatatttggaacgttgtaaattcagtttgaaaactttttcaaactcattttcctactggtaatcgattacaacaatatggtaatcgattaccagagagtaaaaactctttggtaaaggttttgtcaaaaactcatgtgctgttcaaagttttgaaaaactttttaatacttatcttgattgagtcctttctttattcttgaatcttgagtcttgaatcttgatcttgattcttgagatcttgcatcttgaatcttgattcttgattgtaggctttcttcttgagtcttgaattcttcttgattcttgaactcttgacttgttcttgattcacttgagatgttctttgattcacttgagtttttctttgatcttttgagctttttgttcatcacctttgtcatcatcttttgttgtcatcattgttatcatcaaaacacctttgaatcattgttgattcatcatgaagctttgcttccacaatctcccccttttttatgatgacaacttcagaaatcaagaaacacacacacactttttcctagtcgatcactcttataaatgctccccctttgtttttgaatttatgcttatcttaaaattaaattatttactcatgtgagttcttgatttatccctatttctctccccctttggcatcaacaaaaagccaaagtgtgtatttaaacttaaagtatgcaaatatatcttaaacattcatacagcattcataaaaaatattaaccacaacatgaagtaaaaaccatgaagtaacaatcataaatagattaacttataaaatccacatagtcaaataagatacttgttcaaccaaaccatgcaaataaggaaataataaattgttcaaataccatagtaatatagccaaaatacaaggctgaaaatcaaagtagtaatattaaaatataagtctaagatgatggtggcggcggtggtggaagatcaaagcttgaccggatgtaagatacatcttcttcaaccttagtcattcttgactccatttcattgaagcgcatatccacttgcagttccaaagtatcaaacctctcaccaacaaaggtttgaagaccatcaaacctttccaaaatcttcgaaagaagagatgaatcttctccctcatgaccttcttcaccaatatttctagcacccttctttacccatgatccatcatgctccttaatataaccaaaggatgctatgactgaagcgcctataaggaatgatctcttgattggaacataaggttcagaatcaagagggatgttgaaatgttgaaggaagagggtaacaaggtgaggataaggcaacggggcattcaatcgcaacgccttatgcatgcgatatctaacaagatgtgcccaatcaatttgtaaacctttatgaaaggcccacatgacaatgagatcttcttcaaaaacctgggcaaggtttgaagatctaggaagcaaaatgcgaactataaggtaatggaggatgcggctttcaaaagccaatgaaccagcaagaagtcttccagtcatatccgcttggttggtgcaaaccaatcggcgggcatcatgcacagagaaatcgaatttccattcatcaatcagtgcaccctcaaaagtcataccttcactaggcaatttggttaagtcaaaaaacagggattggtcaatgaccatcttaatcccatagatttcagacattagaacaccttcatgaatttctaaattagaatagaaggcttttgttagtgcttagctttacttagttttaaaagattggctaaaattttgttaaaacataaagcacttagacaatgaaggaaagctggagttgctgcacatgatgtctaacattatgtcaaggaatcagattggggtgcacaatgcacaaggcaagataaaatgtcaaatgaagaattgaagctgcaggatccacgatgtcggatacaatgtccaggacatcctgcccgaaaatactggacacataaatctgttatatctttaacagattaatgtgcagtcagcaacagattaggagctctatctttaggaacgaattaaaagataattaaagattgaattacaaacttgaatagtttcgttcagggattagagattgaagataaaaactaaaagataaaactttatcttttagatctttaagtgcagatttttcaggagaatgatagagcttatccagcggaagttgttgcagcccagatacgtacactgctatataaacatgaaggctgcacgggttttttatcaagtcagagattgaagagttattttgtgagttttgtgacttgagtgttttgtgagccaccttgatgttaccctaacatcaagtgttggacctgagtgtgtagagttgatctctattgttcagagagcaatctctggtgtgtctttgatttgtttgtaaacacgggtgagtgattgagagggagtgagaggggttctcatatctaagagtggctcttaggtagaagttgcatgggtagtggttaggtgagaaggttgtatacagtggctgttagatcttcgaactaatactattttagtggatttcctccctggcttggtagcccccagatgtaggtgacgttgcaccgaactgggttaacaattctcttgtgttatttacttgtttaatctgttcatactgtcatatacaatctgcatgttctgaagcgcgatgtcgtgacatcctgtacgacatctgtcctcagtatcagaatttcaattggtatcagagcaggcactctaaatcactgagtgagatctagggagataaattctgatgaacatggagaaagaaggaggaccagtgaacagaccaccaattctggatggaaccaactatgaatactggaaagcaaggatggtggccttcctcaaatcactggatagcagaacctggaaagctgtcatcaaaggctgggaacatcccaagatgctggacacagaaggaaagcccactgatgaattgaagccagaagaagactggacaaaagaagaagacgaattggcacttggaaactccaaagccttgaatgccctattcaatggagttgacaagaatatcttcagattgatcaacacatgcacagttgccaaggatgcatgggagattctgaaaaccactcatgaaggaacctccaaagtgaagatgtccagattgcaactattggctacaaaattcgaaaatctgaagatgaaggaggaagaatgcattcatgacttccacatgaacattcttgaaattgccaatgcttgcactgccttgggagaaaggatgacagatgaaaagctggtgagaaagatcctcagatctttgcctaagagatttgacatgaaagtcactgcaatagaggaggcccaagacatttgcaacatgagagtagatgaactcattggttcccttcaaacctttgagctaggactctcggataggactgaaaagaagagcaagaacctggcgttcgtgtccaatgatgaaggagaagaagatgagtatgacctggatactgatgaaggtctgactaacgcagttgtgctccttggaaaacagttcaacaaagtgctgaaaagaatggacaggaggcagaaaccacatgtccggaacatccctttcgacatcaggaaaggtagtgaataccagaagaagtcagatgaaaagcccagtcacagcaaaggaattcaatgccatgggtgtgaaggctatggacacatcaaagctgaatgtcccacccatctcaagaagcagaggaaaggactttctgtatgttggtcagatgatacagagagtgaacaagaaagtgattctgatagagatgtgaatgcactcactgggagatttgaatctgatgaagattcaagtgatattgatattgaaatcacttttgatgagcttgctatatcctatagagaactatgcatcaaaagtgagaagattcttcagcaagaagctcaactgaagaagatcattgcaaatctggaggctgagaaggaggcacatgaagaggagatctctgagcttaaaggagaaattggttttctgaactctaaactggaaaacatgacaaaatcaataaagatgctgaataaaggctcagatatgcttgatgagatgctacagcttgggaagaatgttggaaaccagagaggacttggatttaatcataaatctgctggcagaacaaccatgacagaatttgttcctgccaaaaacagcactggagccacgatgtcacaacatcggtctcgacatcatggaacgcagcagaaaaagagcaaaagaaagaagtggaggtgtcactactgtggcaagtatggtcacataaagcctttttgctatcatctacatggccatccacatcatggaactcaaagtagcagcagcggaaggaagatgatgtgggttccaaaacacaagattgttagtcttgttgttcatacttcacttagagcatcagctaaggaagattggtacctagatagcggctgttccagacacatgacaggagttaaagaattcctggtgaacattgaaccttgctccactagctatgtgacatttggagatggctctaaaggaaagatcactggaatgggaaagctagtccatgatggacttcctagtctgaacaaagtactgctggtgaagggactgactgcaaacttgatcagcatcagtcagttgtgtgatgaaggattcaatgtaaacttcacaaagtcagaatgcttggtgacaaatgagaagagtgaagttctaatgaagggcagcagatcaaaggacaactgttacctatggacacctcaagaaaccagttactcctccacatgtctatcctccaaagaagatgaagtcaaaatatggcatcaaagatttggacatctgcacttaagaggcatgaagaaaatcattgacaaaggtgctgttagaggcattcccaatctgaaaatagaagaaggcagaatctgtggtgaatgtcagattggaaagcaagtcaagatgtcccaccagaagcttcaacatcagaccacttccagggtgctggaactacttcacatggacttgatggggcctatgcaagttgaaagccttggaggaaagaggtatgcctatgttgttgtggatgatttctccagatttacctgggtcaactttatcagagagaaatcagacacctttgaagtattcaaagagttgagtctaagacttcaaagagaaaaagactgtgtcatcaagagaattaggagtgaccatggcagagagtttgaaaaaaccaagtttactgaattctgcacatctgaaggcatcactcatgagttctctgcagccatcacaccacaacaaaatggcatagttgaaaggaaaaacaggactttgcaagaagctgctagggtcatgcttcatgccaaagaacttccctataatctctgggctgaagccatgaacacagcatgctatatccacaacagagtcacacttagaagagggactccaaccacactgtatgaaatctggaaagggaggaagccaactgtcaagcacttccacatctttggaagtccatgttacattttggcagatagagagcaaaggagaaagatggatcccaagagtgatgcaggaatattcttgggatactctacaaacagcagagcatatagagtattcaattccagaaccagaactgtgatggaatccatcaatgtggttgttgatgatctaactccagcaagaaagaaggatgtcgaagacgatgtcagaacatcgggagacaatgtagcagatacagctaaaagtgcagaaaatgcagaaaatgcagaaaactctgattctgctacagatgaaccaaacatcaatcaacctgacaagagtccctccattagaatccagaagatgcaccccaaggagctgattataggagatccaaacagaggagtcactacaagatcaagggagattgagattgtctccaattcatgctttgtctccaaaactgagccaaagaatgtgaaagaggcactgactgatgagttctggatcaatgctatgcaagaagaattggagcaattcaaaaggaatgaagtttgggagctagttcctagacccgagggaactaatgtgattggcaccaagtggatcttcaagaacaaaaccaatgaagaaggtgttataaccagaaacaaggccagacttgttactcaaggctacactcagattgaaggtgtagactttgatgaaactttcgcccctgttgctagacttgagtccatcagattgttacttggtgtagcttgcatcctcaaattcaagctgtaccagatggatgtgaagagcgcgtttctgaatggatacctgaatgaagaagtctatgtggagcagccaaagggatttgtagatccaactcatccagatcatgtatacaggctcaagaaggctctctatggattgaagcaagctccaagagcttggtatgaaaggctaacagagttccttactcagcaagggtataggaagggaggaattgacaagactctctttgtcaaacaagatgctgaaaacttgatgatagcacagatatatgttgatgacattgtgtttggagggatgtcgaatgagatgcttcgacattttgtccaacagatgcaatctgaatttgagatgagtcttgttggagagctgacttattttctgggactccaagtgaagcagatggaagactccatattcctctcacaaagcaagtatgcaaagaacattgtcaagaagtttgggatggaaaatgccagccataaaagaacacctgcacctactcacttgaagctgtcaaaggatgaagctggcaccagtgttgatcaaagtctgtacagaagcatgattgggagcttactatatttaacagcaagcagacctgacatcacctttgcagtaggtgtttgtgcaagatatcaagccaatcccaagataagtcacttgaatcaagtaaagagaattctgaaatatgtaaatggcaccagtgactatggaattatgtactgtcattgttcagattcaatgctggttggatattgtgatgctgattgggctggaagtgcagatgacagaaaaagcacttctggtggatgtttctatttgggaaacaatcttatttcatggttcagcaagaagcagaactgtgtgtccctatctactgcagaagcagagtatattgcagcaggaagcagctgttcacaactagtttggatgaagcagatgctgaaggagtacaatgtcgaacaagatgtcatgacattgtactgtgacaacatgagtgctattaatatttctaaaaatcctgttcaacacagcagaaccaagcacattgacattagacatcactatattagagatcttgttgatgataaagttatcacactggagcatgttgccactgaggaacaagtagcagatattttcacaaaggcattggatgcaaatcagtttgaaaaactgaggggcaagctgggcatttgtctgctagaggagttatagcagttacttctatctgaacgtgctcaaacttctcacttaacattaatagcacgttcactactgggccaaaacaaattcaacctccgtttcacacgttctcctacattcctcattcaaacttacattttcgtggcaatctcgttttcatcagcattccccaacacttctcagatattcacgaaaccactcccaaagctctgcttctccatggctacctcaccaaaagaaacctcatcccctgtttcaccctctgtaccatcatctccatcatcctccaaaactccatcaaaccaggaacaacctgcactcaatatccaatccatacaaatgattcctggtccaggccctgttcctgagaaactggtccctaaaagacaacagggagtgaagatttctgaaaaccctagctttgcaacaagccctagggaagaagacactgagatggataagaagatccgcagttttgtgaatagcattttgaaaaatgcttctgtccctgatgctgataaagatgtcccaacatcttccaccccaaatgctgaagtcctctcttcatccagtaaagagaaatcaacagaggaagaggatcaagccacagaggagacccctgcaccaagggcaccagaacctgctccaggtgacttcattgacctagaagaagtagaatctgatgaggaacccattgccaaaaagttggcacctggcattgcagaaagattacaaagcagaaagggaaaaacccccattactaggtctggacgaatcaaaactactgcacagaagaagagcacaccaatcactcctaccacatccagatggagcaaagttgcaatcccttccaagaagaggaaagaaatttcctcatctgattctgatgatgatgtcgaactagatgttcccgacatcaagagagccaagaaatcagggaaaaaggtgcctggaaatgtccctgatgccccattggacaacatttcattccactccattggcaatgttgaaaggtggaaatttgtatatcaacgcagacttgctttagaaagagaactgggaagagatgccttggattgcaaggagatcatggacctcatcaaggctgctggactgctgaaaactgtcaccaagttgggagattgttatgaaagtctagtcagggaattcattgtcaacattccctctgacataacaaacagaaagagtgatgagtatcagaaagtgtttgtcagaggaaaatgtattagattctcccctgctgtaatcaacaagtacctgggcagaccaactgaaggagtggtggatattgctgtttctgagcatcaaattgccaaggaaatcactgccaagcaagtccagcattggccaaagaaagggaagctgtctgcagggaagctaagtgtgaagtatgcaatcctacataggattggcactgccaactgggtacccaccaatcatacttccattgttgccacaggtttgggtaaatttctgtatgctgttggaaccaagtccaaatttaattttggaaactatatttttgatcaaactattaagcattcagaatcttttgctgtcaaattacccattgccttcccaactgtattgtgtggcattatgttgagtcaacatcccaatattttaaacaacattgactctgtgaagaagagagaatctcctctatccctgcattacaaactatttgaggggacacatgtcccagacattgtctcgacattagggaaagctgctgcttcaggtgctgtgtccaaggatgatttgattgctgaactcaaggacacatgcaaggtgctggaggcaaccatcaaagccaacacagagaagaaaatggagctggaacgcctggtcaaaagactctcagacaatggcgttgatgatggagaagcagctgaggaagaagaagatgcagcagaggatacagaatcagatgatgatgattctgatgccaccccatgactagctattggggcatgtccctttgaacaattgattgttattggtctgtaatatttgcacattaatttcatgccttctacttttgccaaattctgtctaaaaagggggagtagtaggatattatgcatgatttatgaaggatattatgcatgatttatgattttgagggggagtagtatttatactgctgctgctgatgatgattgatgtaagctactgaaactagtagctgatagaagatgctgcagtgaactgctgcctagcagaatattcacttcacagcagtaagagcatggagacagggggagcagaaagctgatgtcacgtgagatgtcttgacatcctggaaaagacttgtagatttgcaacttgcagaattttgctgtcaccactacagatactgctgtgcttgattactctgataatgaaagttgctgatcccacttgcatgactgctcgtacctgctcaggaagtgtctaagtatgttttagacaaaatttgccaaagggggagattgttagtgcttagctttacttagttttaaaagattggctaaaattttgttaaaacataaagcacttagacaatgaaggaaagctggagttgctgcacatgatgtctaacattatgtcaaggaatcagattggggtgcacaatgcacaaggcaagataaaatgtcaaatgaagaattgaagctgcaggatccacgatgtcggatacaatgtccaggacatcctgcccgaaaatactggacacataaatctgttatatctttaacagattaatgtgcagtcagcaacagattaggagctctatctttaggaacgaattaaaagataattaaagattgaattacaaacttgaatagtttcgttcagggattagagattgaagataaaaactaaaagataaaactttatcttttagatctttaagtgcagatttttcaggagaatgatagagcttatccagcggaagttgttgcagcccagatacgtacactgctatataaacatgaaggctgcacgggttttttatcaagtcagagattgaagagttattttgtgagttttgtgacttgagtgttttgtgagccaccttgatgttaccctaacatcaagtgttggacctgagtgtgtagagttgatctctattgttcagagagcaatctctggtgtgtctttgatttgtttgtaaacacgggtgagtgattgagagggagtgagaggggttctcatatctaagagtggctcttaggtagaagttgcatgggtagtggttaggtgagaaggttgtatacagtggctgttagatcttcgaactaatactattttagtggatttcctccctggcttggtagcccccagatgtaggtgacgttgcaccgaactgggttaacaattctcttgtgttatttacttgtttaatctgttcatactgtcatatacaatctgcatgttctgaagcgcgatgtcgtgacatcctgtacgacatctgtcctcagtatcagaatttcagctttgactaattcagaatagacaggtaatttcagagacatgaatggaataagattggagttttcaaatgcttggaagcattcaaaattctcatttgagaagaactccatatctatgaattttgggtctacaatggaacgagaggaaaagaggtttgtgtaccgtatacgctgttcctctgatgagaataatgatccagagggaatggagggaggaattggtgcttcttgtgacccggaatgcagctgactccgactcgaagttccttttctctttttcgatggttctgccatttgaagagtttttttgggatttcaatcggttcaaatgaaagagattgaaaaaagatgaagtttgggctttgtggggagtgatttggataagaattgagtgagatatggctggaagaaaaattgggggcgagggttttcgagagaatgaaaagttgcaggtttcagaatttgaaatttgaataaataggtgcagggacgcatcgtaatcgattacacacaatatggtaatcgattaccagagagcaactttgccagaaataactgcttgtaatcgattacactattatggtaatcgattaccagtggttattttagccagaaaacaaaaatagaaggctttctaggagagaagaagttttgaaaactatttttgaaaatactatatttgaaaatactttatgactaattttcactcatgtaatttacatatcacgtcatgcaaaaatatttaaaacatgaagataatcaattttatcaagaacaattacaacacaagtatgaagaatattgattttacttaaataaatgaatgaatatttcatgcaaatagaatgaaatcaatcaagcaaatatactcatgatttcaatcaatcaaaagacaaacaaataaagaatttttagtcatcatagtcaatttgtttgaataaaaatttcaactttaagagaaattttaataagataatggttttgatattacctttttcagaattgaagagtctagatcttcaaagatgaggatcatgctttttatccttgagagaagttcttgtcactttcataatctttagttagaagattaatctccttttctgaaccatcagatgaatcattgtcatcccatgcaatgtatgctttcttagttcttctttcgtcaaatcttttcttttcacttttctccgaccattcttcatttgacggacagttggccttgatgtgaccaatttggttgcatttgtaacacctaaggacttgagaatcctcttgtgattttcttccattattgaaattctgacgcctatcaattcttcttttcttgatgtatttctgaaatttcttaacaaagaaggaaaaatcttcatcatcagaatcttcttcttcgttttcttcttgtattgaagatgaggctttaagggctatgcttctcttctttttgtcattttcttcattctgattgaggcgttgaagttccatctcgtgttcctgcaatttaccaaataaagtggcaagagacatggaagagagatctttgctttcagaaatagcagttaccttgggctgccattccctacttaaacatcttaagactttattaattaaatcctcattaggaaaaacttttcctaatgatgcaagatgatttacaatatgtgtaaaccttttttgtaaattctgaatgttttcatttggattcatcctaaataactcatattcatgggtaagagtatttattctagaactttttacatctgtggttccttcatgggttaactggagagtatcccacatatccttggcattagtacaatttgacactctaaagtactcatctatccctagggctgaagtgatgatatttttggctttgagatcgtactggatttttctcctatcttcttctgtccactgatctctaggtttttgggttgaagtacttgtgcttacatctactatagtgggtatatgtggtcctaattctattgcttcccatatatttagatctatggcttcaatgaatatttgcatgcgggttttccaataatggtaaccctcaccattgaaaatgggtggtctgtgaatagaatttccttcaggaaacaagggatttgaggaggccatcctacaagaaacctgctctgataccacttgttggatcgagtggcctcagaataattaagaagggggggggggttgaattaattattccaaaaactttaccaattaaaaattactcttttaaggcttttacttttgttgttaagagaatatggagtagaagagaaacttaacagaaagtaaaagcgaaaattaaatgcacagtggaaagtaaaagagtatggaagaaggaaacaaacacacaagagtttttatactggttcggcaacaacccgtgcctacctccagtccccaagcgacctgcggtccttgagatttctttcaaccttgtaaaaatccttttacaagcaaagatccacaagggatgtaccctcccttgttctctttgaaaccttagtggatgtaccctccactagaactgatccacaagagatgtaccctatcttgttctcagtcaaacccaagtagatgtaccctctacttgtaccacaaaggatgtaccctccaatgtgttaagacaaagatctcaggcttttaaacctttaatactttgtgaatggggatacaaaagaattctcaggcggttaaacctttgaacgcttttgtattagggaatgggaagaatcaaaagaattctcagactgtgtcgttttgaattctttgacaagggagaagggagacacaaaagaattcaagcggttagtcctttgttcttttggaaaagggagaagagagacacaaaaagaattcaggcggttagtccttggcaaatggcaaagggagaagagaatgaaaaggatgaatagcacaagttttcaaggtttagaaaaccagaaaacttcagaaagcttttggtacaaagaagaagaagaagttcaaagagattcaaagagattcaaggcttgtaaaggattgtatgaataattgttcaagattgttgttggaaagattgattcggaatgcaaaacaaagtcttgcttttataaactcttgatgtctggtcaagaaggccattcagaagagttataactttttagaaaaacttaaaacccatttgaaaaagtcaaaacctttttgaagagttacatctttagatttttaaaaaacaaacactggtaatcgattaccaaatatgtgtaatcgattacacaaagcttttgagtgaaacaatgtgactcttcacttttaaatttgaatttcaacgttcaaggacactggtaatcgattaccaaaacattgtaatcgattacagccttttgaaaatatttggaacgttgtaaattcagtttgaaaactttttcaaactcattttgctactggtaatcgattacaacaatatggtaatcgattaccagagagtaaaaactctttggtaaaggttttgtcaaaaactcatgtgttgttcaaagttttgaaaaactttttaatacttatcttgattgagtcctttctttattcttgaatcttgagtcttgaatcttgagtcttgaatcttgatcttgattcttgagatcttgaatcttgattcttgattgtaggctttcttcttgagtcttgaattcttcttgattcttgaactcttgacttgttcttgattcacttgagatgttctttgattcacttgagtttttctttgatcttttgaactttttgttcatcaccattgtcatcatcttttgttgtcatcattgttatcatcaaaacacctttgaatcattgttgattcatcatgaagctttgcttccacagatggtggtttaggcttgaaaaaaaagctttgtcaaaagtgttggtgtacaacaatctatgcacaaggatctcgttaaactcatctgggagataagaaatttgttttttcatgaaaattttcaaatatgttaacaattgttgatggttgattttaaagattaagatttttcacgaaattctttagatctgttctattacttgattcaattgaaaattgtttaattgtatcgtattattttattatatgatttttgttgttgtatttgttgtctttggatatgtaaatacatcttcattatatttctcaccggaaagagataaagatagaaaggctaaaaagaaaaaacaaataacaaaaaaatcttgattgttagattaaaaataaaataatctatttttaaaaaaaaggaagcgatcttggacggttgagataagagaaacttgcaaacacattgagtaatagatatatccaaaggccaaaaaatagttacacatgttgcaggacctatcggactttaccacactagaaggcgtcataacctatatcaaagtgtcgcaacctacccttcgacgggacggcgaggcgaaaagccaaagttgcgtcttctcatgaagaaagcgcgtagagtcgccaccaacgtttattcaaggaaaacattagaaaaaaccaaaaagaggtctgcggattttgaaaataagggttcgggagttgtttacacacggggaaggtattagcaccccacacgcccgtcacaagagacgacagcctttaatcgaatgtgcaaaaatgtgacttcaaaattatgtgaggactttgagtcctatgaaagataaaagtgaggactttgagtcttgtgaaagataaaagcgaggaatttcaatcctgggaaaaataaaggcaaggactttgagtcctctaaaagataaaggcgaggatcttaagtcctctaaaagataaaggtgaggactttgaatcctctaaaacaagccaataagcactagtaccaatgggctcaaccttaagagaaagcaagagatcgactttttgagagggcctctcatccttaacttaaaaaattagatttggtaaagtggtatataaagagaaatctacgcacttatagcctaatatgaacatgattttgggatgcagatgcatgcaaccttcatcttgaaatgctaataatgcaaaaggttttgaatcatgaaaattgtgtaatgctcatgacattctttcctatttttgtgattttgattttgatttgatttttttttttgtggaaaacacatattgactgtctctttctagaagacatgataattcatgcaaccttattttttttttttttgcaaatctcttcgatgactcccttagagtgtatgtttttgtttgatcacttgaaaattttggagtgacggcaatggagctgttttacatttaatcaatcaaccgaaacattgatcctagggtttgtccctttcttttttgtttaaaaccttctattgttctgcacagcaagaaaacataaggctttgggatcgattgtgcaccacactgaaggatggcaatgaattgtcacactttggtatgtgaccaagtgaaactttcctgatttaaggtcatagagtgatgccaagggtttgtcgattccactgaaacttgatgaaatgggctaatcccgaaagaatttataccacaaaggccaccctggattcaaaaggaattctaaggagtctgcatgagcaactaatatcagatgtaccctactatcacaattgtctttgggaattttccatgagctcctggtcgaatgagttttcttctcagatgtaccctactatcacaattgtctttgggaattttccatgagctcctggtcgaatgagttttcttctcaaatgtgcaagtacaaaacctcgaggattctttttgttttgtttatatatatatttttttaacaatcacaagcgtgtgtaggtttcattctagaatcccaacttaaaagaaaaattagtcattccttgatccacatgggctttactgggcttgtaacgtggtcaggggtaagaagactatgaaagaaaggatttagagaggcttaaagagtgtttaagggttacattgagtaagaacctcaagagcattgcttataccttttgggttgagctctactccttttgtcttatacagtaatctttattgcacttttgtgcctttcttgtaagatttggagatcttttgtctctttttttttcttcactcgcctttggcggactttatctctctttttttattattgtttcccaacttcatgcatgtgttgtttgcattgctcttcccaccagtttagcagtggttcctactcagagttcctattttgtttttgttgtttttcgaaaacaaatatgctttggttcggagagggtagcaagggataaattagtgtttgggatgttgaaacatggccatgtgtcatttcaaatcttgactagatacttttgtagtttggattttgagacaaaaccttaataacacgcccctaattgtttgttttttttcttttttattattaccctaacttttgcctaggtcaccctttcaggttctgaacctatcgggtaagaacttctgatctgcccctaagtttgcttgaggctcatgcatggtgcctctcattgccccaatgtagggctctgaggtatctattgttgccttttgtcatgaccttgtagcaaggaaaaaaagaaagaaactatgcaggttctcaaaaatgaattccgaaggatgagaaatgtttaaaggattttcaattgacagattaagtcgaacgactcttgttcttgataattcacttttctctcaaaaagaaaacttttaagaatgataaaataaggtcacatgaatgtttttacttcttattttttatttgaaacacgattaatcaaacgttttttttttactttactcgtcgtttacggcaccctcaccaaacgtgtagaacgagcaatttctgattgaacagacttggagatcaactcagaagtgcaggttgcttgagccaacaaaccaatggcttacattcacattccagtgaaagtaaaataagcaaagacgtaattgcgagagaatgagagacaaggacatcaaatttatccatattattagcattgtgactattgtttataataatgccataaacttaaaaatcctaatgagtcattggagacatctaacaacaaccttcaaattgccccatgcatagtgtagcttgacaacgttagaattcgtaagcgattgtcctcctcgaatttcaattagactttgcaccttacgtttcagggtcatacaatgctcaatggaattcccaggaactcctccatgataagcacattttgcattcaagttgtatcctcgggaaaatggaggttgaggaatctttgttgggattatgactaccattgcattattaagtagatatgggagcaaattagcatacgacacgggaattggggtgaattctacaggcttcttttctagaaaattccttccttggttagtgttttggtttgtgttaagggtggtgtttgatatcggatgtgcgacaggagggctttgcggctgatttaggggtggcctttgtggatgattgggtgttcttgactggtagggtggtgggcaatgagaaggactgatattggctgagtgttgacattgttaagttggcgagaaatttggccatgtagggacaacagtcatagcacgggttcttccctccttcttattctctccattttccccaagcttcatattcatccaagtaggataattaaattttcctcttcttagatccactttgatcctttcgctggcgaaaaccaaatcaacaaagcttgaaggcatgtaacccaccatcttctcatagtagaacatcggtaacatgtctactatcattgttatcatcttcctctccatcattgggggcgctacttgagttgccatatccctccacctttgggcgtattctttgaaagattcatgctccttcttgcacatgttctgtagctgcattctatccggagccatatcagaattgtattgatactgcctaatgaaggcaaccattaggtccttccaagaatggactcgggaaggttccaaattggtatactaggtgacgactatctcagtaagactttcctgaaagaaatgcatcaataatttttcatctttcgcgtatgccccccattttcctgcaatatatcttcaagtgattcttggggcaagtagtccccttgtacttatcgaaatctgacaccttgaacttcggagggatgacgacgttaggcactaggtacaactctgccatgttagcaaaagcatgatctccgcctccttcaatagccctcagtctttcctctctctgattgaatttttccctttccaccatagcaggagggactcttcccaccgcaaaatgcaagggttgtggttgtgggaaaaactaagggcccccaaagtgtttggcaggggtacaccactaactgcttgcccttcagtggcatatcggaggtgaggttcgaagtcgattatattatggtctcggggtgcttcatgtgtctcctccatgggttgagagacatgtgcatgatcagattggggtttttggctctcaatgggtatgggggcatgaagttgtcgacattctcatcgtgagtgtgtgcaacattgggtggtgcgtagttgggaggcaagccagggaatgaatgcttgctctaaacttgcacaaaatggtgactggaggatttacttgattgaggctcgataagtaagtcaggtctacctcagtggtgacactcgtagtggcaactgcaaccgcattgctttccattattttcttcatgctcaacatggcctccatcatggcggccatttggtctttcatggcctccatgtcggccttcatctgttcttgcacttcttctatttcactcattattctagctcaggcacgcgttcggtaagggcgccataaaagtgcattctttccttttgattacaatgattacagttttgatttcaaggaaataatgaaatgagcaatgcaaccaacgtgaaaagaaaaaataagcatggatgtatgtgaacaaatacattgttgaagtattgcaaatttacatagggcactcaatagggtcgaaccaatttagattttcattaaaacaacattgttcattacattttgtcaaaatgcaataggaaataacgcatggacatcaacaatccctaatttttgttaattatttagctcaaccatgtgttggcagtagacaaagaagctatgtaaacttgatccatcttctgccccaacttttgcaagctagttatttccatacttgactttgacttgatgaaacctttttcttaaaagcatgtgcttggttcgaccccataatccaaggaatagaaattttgactgtcaatacttcaacaacatatcatagagatgaatgacttgggcatacttatgctatgcatgacacatgtaattatgaggttgacatgagatgcttgaagaaacatcatttccaagttaaccatgcattaggtaccatgttcacatgattttcaataattttttaagagaaatgagtgcataatcccaacatggttggtttatagctatcatcatagtacccaacacatgtaactaagaatgtggtgtaaactttcacactttatggtgactttcttttgttctttctttctttatttttaatttttttttttttgcagaggaaaatgcaaggatcatgcatgcaaactatgaaaatagaatgtatgcagttggcagaacaaaagcatgctaaatgaaaatgcatgacaatgcaacaacttatgcaaatgcaatgcatggatatgacaaatgataaatgcaagaatgatatgtacattatgatgccatgaagagatgcatgatgcgatcaaagaacaagccagagtgagttttctatgtgccaccctaatttaggaacctaatggaaaggatccaaaagtccccttctagtcacaacttccaaggatggtttcatgtaactttaccggtctctagagatatcatcctgttagataatacattgtggcgatagggactatcagcgacaatgcatcaccaaaagaggaaaactctagataaggcttcactgttaccaagcgagtcagagacccagcatgaacacagattgacctccactccttatggctcacatagacccgggtatagggcctaatatctcaacgtgtgtgcgaggcgtaggtgccatgtgtgcgtagaaaaaaatatttctaactatgaatgtaattgatagacaaacacacaccaaacacaacaacatagcaaagattatatacaaatatggacaaaacaaaagataaaagggaaaagggaacataaataaagaagaagtcacgataaaaacattgcacactggctgaatgacctaactctctaacagtccccagtggaattgccaactgtcacaaccaaccctttggcgaaagggcgaggcgaaaagccaaaggtgcgtcttctcatgaagaaaacacgtgaagtcgccaccaacatttattcgaggaaaacgttagaaaaaaccaaaaagaggtatacggattttgaaaatatgggttcgggagttgtttacgcacgaggaaggtattagcaccccacgcatccgtcacaagggacggcagcctttaatcgaatgtgcaaaaatgtgacttcaaaattatgtattttccctttttatattttttattttttggggtcgacaagggtgttgcccttgcttctacgtatcctcaggtgcgatgaggaatttaaacctacatagttctttaagtctgaaagtttgtgtgttacattaattttatgctttttaaaagatcgattttaattgcgaacaaaagtcgtttaaggcattggaccttgaaacgatgttttaaaaatttgaaaagcggagagaatggttaaggcgttggaccttgaaacgacctcaagtgatgtttgatgaaaagcagagagaatcgttaaggcattggaccttgaaacgatctcaagcgatatttgattaaatgaagaagtttatgagttggttttattttggttttgcttattaaccttcaatcttttttaaagataacttgtaagggtgcacaaaacaagaaagaggatgaagatgagattattgatgataaaagaaggagatgaagatgcacaaaacaagaaagaggactcgtaagggtgcgtagatcgcattcaaatccttaaaacaaaaactaaccggatgacaaacgaataacaaacgaagaacaatgtagaagtcgattaggatcgcaattcggtagcacctcggcctcgtttttctcttctttcttcttcttctctctgatttctctcaatgttggaccttggaaccctttactcagcctccctcacacctatttatagcaaaagatggcattaggagtcatggcagctcacccaggcgagttatagcttcaacctgaagtaactttgcttgcccaggcgagctagttatttcacccctaagctattttggggcctaagcgagccaggggctagcctgggttcagaaaaaggcttaaaatgaccctgttgccctctttttttgggtattttctgtattccttatggaaacatcaaatgatctttcatcttgcacggtaactggtgtcatacagcttaattcggctagcgaggatcaaaagatcaacaaatgatagtcttagaacgaaattagggtatgacacaaagttattaaactaacactcgtagtctttattgtctaagcctttctacgccccaggaatctggtgggactaaagcgcttaagattaacaatgttggaatgtccatcaataacaagctcagcaacaactccagtggcaggaccattaagaatattatcccaattatgccctgttgcaacataacaccccttcacccctggaacctctcctattactctcccttcacacatgccactccttccctaagatggcttgaaacagtcttcaccacctttttaagcatcacaattaattcagggtttccctttatctcctcacgattatccgaaacttctttctccttcgacatcccacatatataaacctcccctgaaaataaatgtttacattattaacctctttattaatattattattactaagtgtgactaattactacacctgggaatcaacaagttgcgtttgtccgaatgatactagattctgtttggaagggaagaactcattaaaagtgaccagttaaattctctaataaaaattaatgattggtaaagtcggtagatgttctgtaaaaaaataaaattaacatacctgtgtggggagggtacacttcggggtcaagagattttcctcgtttagaagaatagtaactgagaaagagggcatgcagggttatagaaccgggctctctggcctctaatacaatgctatgggccttaagcccataagcccataaactatgaacaacaaaaccaacttactggactaagggcccaatgttaacaccatagaatccgcttccaaaactcgtccttcttcaagcaccatcgatccaactcatccttcttccacttccaaccgttcctattttgtaatctctatcttcactccatgcttctccactgatctatcaatcagcgcgggaatgaagagccataggtgcacctgcactgtcatttcgatggttccaaccacgagtaggtctgtcaactcaagacgacaacattgaggtggcagaaaaggagccttcaaattccgtaacgatgaggctgagagtggtgagggttctgtaactgtacgatcatgaaccgtctagttcttcgaagagtgaacggtggaggttgaagctcatgtgagctagctcttctagcggtcctctattgcaccaattgagggcaaggaatctgccagctttttcgaatgcagtgcatgccacgttgaatttctcaatgagcatgatatagacacccttcaccgccagaaagtaggcggtgcagacttcgatgactccatcgccgcaaacaaccacttgcttcgaatgatccatggacagtgaatcaatcaactttgctgtcaagatgtgaattctgttttgccaaaatgcaattagtggtggccacaccccaccacttgattcattattcatactcatccaaaatcttttttcttttattttttatttttaatcaagcacatgtttgttagtatgtttgttcacgttccgacattggcaaaaacttctactatttgatggactatttgggcccttctgataaaagaagtgcatatccaatattagcgaactactataggcaccacctactttttctaatggcactaaccgtgagggtgctttttgtccatatttcaaaactgtccccttaaaaattacataatagaaacgtgcttccattgtgcaattggggtgaaaaaaatgtacaacaaaagtacactttctttgtgtatttttccccctaattgcataacaaaaacatgttttcgttgcacatggatagttacacaatggaaatgtgttttctttgtctagacatacaacaaaaatgtgtttttgttttgttagaaagcataaaaaattacacaatgaaaacatgtttcatttgcacatgggtagtgtcgcaacctacccttcggcgggagggcgacgcggggctcacaggtgcgtttttcaagaaaggaaaatgcacggagttgccaccaacatttatttgaggaaaacatcggaaaaaccgaaaaaggtgtggtctacgaactttaatcgtgaaaggttcgagagttgtttttatgcacggggaaggtattagcaccccacgcgtccgtcacaagggacgacaacctttaaccaagtgtgcaatatcatgtcttcgatttgttttattttccctttttatgtttttatgtcttttttatgctttttgtattttttttatctttttgtggtcgacaagggtgtttccctcgctcctacgtatcctcaattgcgatgaggaaatcagacctacgtagttctttagaactaaacgttggttaagttgtttttatcttttttcgcaagatatattttaaccgaacaaaaggtcatttaaggcgttggaccattaaacgatcttttgattttgaaaggagagaaacgttaaggcattggaccattaacgatctcttggtttttgaaaggagagaaacgttaaggcgttgaaccattaacgatctcttggttttgaaaggagagaaacgttaagacgttggaccattaacgatctcttggggtggtcaacaaaagcggggcttttgctcctacgtatcctcaattgcgatgaggaaatcagacctacgtagttcttgcaaaagcggtaaagttatgtgttgattttatgctttagaacggtccatgttaaccgataaaagcaaagatgatcgtttaaggcgttggaccttaaaacggttttgagtgacttttgcggacgaagcttgatttgtgagttgattttagccttaatttcactttgattattagtcaattcattcaaggaaacttccaaagaaaaacatccgattgatttttttgattattttattcaaagatattttgattattttattattatttttccctttttttgtctaaccgtggttacagtgtgaacgattgattagattttactttaatggtgattaatcgagattacaactcaaatgatcggttgaaatttattttatcatttactatgtgagaaaacggattaaataaacggttaaagcacgataaaagggggtacggaaaacaaacgaaatgaaaataaaagtacgcgaaacaagtagggaccactaagggtgcatagaatgaattgagagattcaatttcgggaacttatcgaatgaagaccgaagaacgatgaagaacgaacgaagaacgatgaagaacggtgaagaatctccacgaaatcgcctacggaaacgtctcggaagtgttacggaagcacctcggcttggatttttttcatggaacaatttttctcactaatttcgagagaattctcaaatactagaagggctgaaccttttgttttgccctctttccccaatttataggagaaaaaagggaggtggttgccgcccagctcacccaggcgagcagggttgtttccactagaaggcaccaccttcttttggaactctcaggaaggcccaagtgggcatggttgctatttgcaccccctttttcactaaacacactcccttttgtgtttttttattgattcctttccgaaacgttacggaactttacggattacgtaacaacacccattttcattttggaatgttgcgaaaccttacggattacgcaatgatgcttgtttttttccttccggaatgttgcggaactttacggattgcacagcaatacttgttttgacttccagaatgttgcaaaactttacggattgtgcaacaatacttgttttgacttccaaaatgttgcgagactttacggattacacaacgatgggtgttaaacattttgaggcggtcaagagaaggtcgcatgccaacaaataatggtccctggacgaaattagggtatgacagttgcccctctttacttatcttttattggagataaaagcgaagtaaagataagacactaatttcgttcgagcagaacatcattcggccgatcaatatcccaaccagcggaacctgtcatttagaaagaaaagaaaaggcaccagaagcgttagcaaaacttcagtgtcttgaaagcgataaaacaggataaccatgacgtttccacatgctatcgaactcgatcgtccctgcctagcagtgaagaatcttgcgcgtcgtcggacttgaatgtctctggatgacgaaagtaaaacctgcaaaaattttcaaaaataatcagaaccggacgaccacatcatcccgataccatcgaactcgttcaccttggttgacgaaaggtgcggataaccataaggtacccccgcatgtcatcggattcgccgtctttggatgacaaaagtaaaaacctgcaaaaatttcaaaaaataatcagaatcggacaaccaacatcatcccgataccatcgaactcgttcgccttggtggacgaaaggtgcggataaccataaggtacccccgcatgtcatcggactcgctgtctctggatgacaaaaagtgcagaagacgatgttagtctatgcgtgtcaacgggctcgcttgcctctggttgacaaaaggtacagaagacgacgttagtctctgcgtgtcaacgggctcgcttgcccctggttgacgaaaggtacggaacacaacgttagtctctgtgcgtcaacggactcgtttgcccctggttgacaaaaggtgcggataaccatacggtacctccgcatgtcatcggactcgccatcaatggatgacaaaaggtgtggataaccatacagtacccccgcatgttatcggactcgctgtctctggatgacaaaaggtgcggataaccatacggtacccccgcatgtcatcggactcaccatctctggatgataaaaggtgcagaagacgacgttagtctctgcgcatcaacgggctcgcctcccccctggctgacgaaaggtgcaaaagacgacgttagtctctgcgcgtcaatgggctcgtttgcccctggttgacgaaaggtgtagataaccatacggtacccctgcgtgtcatcggacttgccgtctgtggatgacaaaaggtgcggataaccatacggtacccccgcatgtcatcagactagccgtctctggatgaaaaaaggtgcggataaccatacgataccctcgcatgtcattggactcgctatctctggttgacaaaaggtgcagaagacgacgttagtctctgcgcgtcaacgggctcgtttgcccctggttgacgacaggtgctgataaccatacggataatcgcttgggtatctccacatgtcaccggactcgccgtctctggatgacaaaaggtgcagaagatgacgttagtctctgcgcgtcaacagactcattcgcccctggttgacgaaaggtgcggataaccatacagtacccccgcctgccacctgacttcccgggtcagggttaacagaaatcgtttgtacgaataaccgcttgggtatcttcgcatgtcaccagactcgccgtctctcgatgacaaaaggtgcagaagacgacgttagtctctacgtgtcaacgggctcggttgcccctggttgacaaaaggtgcagaagaagatgttagtctctgcatgctaccggactctgagtctgacggatagcaaatgaatgtgtgcgggttaccgtatagggcatctccgcgcaccaacggactcacaggtcacgatagcaaaaggttgggcggtcgacaaaagcgaggcttttgctcctacgtatcctcaatcacgatgaggaattcagaccaacatagttcttgcttttgtgatactaaaatagtctcggtgttttttcactaaaatgcaaacaggctttagtaaagaaacaaaacctccaactgatcagagcaacatatgatttttgatgaaaaacaatgtgtctaatggggaaggagagtatgctaatgaaattttctcataaccataaatgagattttggatgttagcattttgtttctaaacgaccatttagaggaaacactgggtccaacaaaaatagaagaaaatcactcaaagtgtatcaatctcacacaggtaagtgtttcatcctaattcagaaccatagatatgtcatgacttgattttgcaaatcatttcctatcaaatcaaagattacatgtgtgatcacagatcaataggactttttcgggaatggtgtttttttttttgtgggaaatttggctctgagtgttttggccttttccttttctgtttttgtttagtgcggggcgaaaaagtcaccgacgcacaggattttggttggcaatcaaacggagaggaccacttcaagtcgtggtttcctttctttccttatttggctgtgactattccgtattgtttggatatttgtcttgtccgaagacacttctgtataattctttcattgtctttgatcggagattttctcctttttttttctctttgttttctcacaatctttgatcaggaatttctttttttcttttgttttctttcgatctttgatcgggaactttctttgttatggaagcatgttagcaactcaatagtgaatgactttttttcttgggagaccctattgctccttcttctgaggacagggatggaaattctcatcctgggtcaaggtttatggtggtttgaggtcttgggtcaaaaggcttgtagaacggccggacatgatgtatgtcagggtgttggtttggccagcggttcagggataaaggaatgtctcacattatttccatgacacacatgcaacaatgatgatttagaaattttatgcaaaactggtcatatatgcacccatgtggacactcaagtatcaagtttttatggtcatgtgacactagggcccaggattcattttccctatttaagtcaacctagtgtttccaaaacatgttttttttatcaattcatgcatccattcgagtccattttgggcgttcagaaaaatttcacagcattcacccttcaggtgtagacacattttcctcaaaaacccttgtgttttgattggtgactctttccaaagaaaagctggagactatttcttttcaaaagcatgttggctttttagttaaccaattattattattattttgtttttttgtttttgtttgttttttcatgaggtattttgctacctaaacatatgtatatttttgtgaggtatttttgctatatacatatgtatccaaggtatcttgctacctaaacatacatatatatatattttgtgaggtatttttgctatatacatgcatatccaaggtatcttgctacctaaacatagatatatatatatattgtgaggtatttttttgctacctaaattacatacatgtatatctaaggtattttcgctacctaaacacacatacatatattttgtgaggtatgactaccttccgagcttgtgcttgttttatttaaattcctaggatcatgagcaactaggtgtgtcctactatgacttgagaaacaaaggtgatcaaataacaagcagagatttaaaaagtactaggttgcctcctagtagcgcttctttaacgtcttgagctggacgtgtgatgacttgtcgatcacagacctagtacttttgcttacctttggctttggaattggtcgcctgctggtcggtcatgggtcgtaggcaacgctccagcctttgtagatgagttgaggggctctggaggtggtggcggtgtatctattgcccgctgccgtccatccctaggctgctgtggtgtctcgccctgcgcctgcctgggggcgcaatacttcttgatgaaagcttggttaatatggggcctgatgaccttgttgggggcgacgggcactccgtagaattgacaaaggcccataatcagagctggaaacctcaggaccctgttggacttctccgggtccactggtgtcttgcaggcgcgatccctgcaaatattggatgacatcagaaatcaattgagagatgtgcatagttacctatgtcacgatggggtgaccttactgggggggacggacaccctgtaggactgacagaggcccgtaaccaaagctggaaaccccagggccctgttggactccttcgggtccattgggtgtcttgtgggcacgatccctgcaaataggggatggcatcagaaatcagttgaaccacgtgcatacttacctatgttacgatggcatgagcttgctgggggggacgggtaccctgtaggactggcagaggcccgtaaccagagctgaaaaccccagggccctgttggactccttcgggtccactgggtgtcttgtgggtgcgatcccaactgatacttccatagggggagttcgacattgtggtcactgggcagaatgttgctaagtagcaacgtcattcatatctgtgtaagagtggtcatgttggtgcgcatgatctgcactcgtctctttgcagtggcacgggagaaatcttgccccggtatgcacagtagctgcgcgatagcctcctcctctggttgtgctcgcatagttggccctcctccaggatcaaggggtggcccaggagctgataaaaggaaactactggccccttaaccgggagcgcaagtctcggttaagcattaagggcagaggaccttaaattctctaaaggtgcggatgtggagcccactgaaagtgaggacacatcgccctctaaaggcgagggcgtgcagccctttgaaggcgaggatgtgtagtactctgaaggcgaggatgtgtagtcctctctaggtgaaggcatgtagccctctgaagacgagggcgtgtagtcctctgaaggcgagggcgtgtagccctctaaagacgaggacgtgcagtcctctgaaggcaaggacatgtagtcctgtgaaggcgaggacgtgtagtcctgtgaaggcgaggacatgtagtcctctgaaaggtaaggacatgtagtcctttgaaggcaagggcgtgcagccctctgaaggcgagggcgtgtagtcctctgaaggcgagggcgtgcagtcctctgaaggcgaggacgtgcagtcctctgaaggcgagggcgtgcagtcctctgaaggcgaggacgtgtagtcctctgaaggcgagggcgtgaagccctctaaaggcgaggacttgtagccctctcaaggcgagggcgtgcagccttctcaaggcgaggacgcgtagtcctctaaaggcgagggcgtgtagcactctaaagacgaggacgtgcagtcctctgaaggcgaggacgtgctatcctctgaaggcgaggacatgtagtcctctcaaggcgagggcatgtagccttctaaaggtatggacacgtagtcctttgaaggcgagggcgtgcaaccctctgaaggtgaggatgtgtagtcctctgaaggcgagggcgttcagccctctaaaggcgaggacgtgtagttctctgaaggcgagggcgtgcagccctctgaaggcgaggacgtgtagtcctctgaaggcgagggcgtgaagccctctgaaggcgaggacttgcagccctctaaaggcgagggcgtgcagccctctcaaggcgaggacgtgtagtcctctcaaggcgaggacatgtagccctctcaaggcgagggcatgtagccctctaaaggtaaggacatgtagtcctctgaaggcgagggcgtgcaaccctctaaaggtgaggacttgcagtcctctcatggcgagggcatgcaaccctctcaaggcgaggatgtgtagtcctctgaaggcgagggcgtgcagccctctaaaggcgaggacgtgtagtcctctgaaggcgagggtgtgcagccctctgaaggcgaggacatgcagtcctctgaaggcgaaggcgtgaagccctatgaaggagaggacttgcagccctctcaaggcgaggatgtgtagtcctctgaaggcgaggacgtgcagtcctctgaaggcgagggcgtgcagtcctctgaaggcgagggcgtgcagtcctctgaaggcgaggacgtgcagtcctctgaaggcgaggacgtgcagtcctctgaaggcgaggacgtgcagtcctctgaaggcgagggcgtgcagtcctctgaaggcgaggacgggtagccctctcaaggtgaggacgtgtagtcctctcaaggcaagggcatgtagccctctcaaggcgagggcatgtagccctttaaaggtaaggacatgtagtcctctgaaggcgaggacgtgcaaccctctgaaggtgaggacttgcagtcctctcatggcgagggcgtgcaaccctctcaagacgaggatgtgtagtcctctgaaggcaaggacgtgtagtcctctgaaggcgaggacttgtagtcctctgaaggcgagggcgtgtagccctctgaaagtgagggcgtgtagccctctgaaggcgaggacgtgtagtccgctaaaggcaataggttctagtaccgaagggtccacccctatgagaaagcaaaagattgactcatcgagagagcctttcatcccaaattaaaagttgggacattagatgttggaaatctatgtagttaacatgatttttagggatgcagatgcatgcaacctttgtcttgaaatgcggacttcgtaaccatcattgccccagtgtagggctttgaggtaaccatcattgttttgtttccacaaccttgtagcaaggaagaatgaaagaagcagttgattcttgcaaaaagaattttccaaggacaagaaatagtcaaaggatttttcagttgacggattaagtcaaatgactcctattcttgataactcacttatctctaaaaaagacaaactttccggaatgataaaatgagtcacatgaatgtctatattttacttgaaaacacagtcaatcaaatgcttttttccttttcttttttccttttctactttactcgttgtttacggcatcctcaccaaatgtgtagcacgagtaatttctaattgaacggtcttggaagtccaaactcaggagtgcatgtcgcttgagcaaacaaaccaatggcttgcacccacattccagtggaagcaaagatgtaattacgagaggatgagggacaaagatgtcaaatttattcattttatttagcattgtaactgtggtttacaataatggcataaacttgaaaatcctgatgagtcattagagacatctaacaaaagctttcaaatatcttataaagtttttaagtaaatattacatcttgaaaattatgtatttctctctggtaaccgattactagaggctgtaatcgattaccaaaagaaaaaatgttttttaaacaactttcagaaaagtttaaatttgaattttaaaatctataatcgattatcactattgtgtaatcgattaccagtcacaaaaggttttgaaattcaaactgaaaagtcatgactccacaaaattaactgtgtaatcgattaccacatatctgtaatcgattaccagtgaggaaatttcagaaataactctaaaaattcacaactcttcataaatttttttgaaaggtcaccaaaggcctataaatatgtgacttgtgttcgaaattcttcagagtttttcaaaacattcattgtcctatcctctcacaagaaaacctttagccaaacacttgcaaaatcattaaggattcttataagttcttcaagttgtatcattcttctcttaaagagagaaaaacatcttatgtacttcaaaagcaatctgttgttgtaatcaagaggtagtgggtctcttgatttgtaagttctctgaacacaagggaaggatatcccaaggtggttcagaagttgtaaaggaatttacaagtatagtggaaatctcaagtgaattacttgaggactggacgtaggcacaggacatggccgaaccagtataaaactgagtttgcaattctctcttccctaaactcttttactttattgcaatttatatttactttgcatattcaaagaagcatcaagtaaattgtttattacttcttttttctgcatattaagtctacatatttcttttaaagagagaattaaaacttgttaggagaaattttttaaacttaattcaccccccccccccccctcttaagttattgagtttacttgtgtaacaagtggtatcagagcttaattcttgtataaggtttagaaacttcaagaatagttatggcctcatcaaattttttatttcccgaagagaactctataaataggcctcctatattcaatgttgtgggttatcattactggaaaacccgaatgcaaattttcatagaggctatagatttaaacatctgggaagccatagaaattagtccttacatccctactatggtagcaggaaatgcaactatagaaaaacctagggaacaatgggatgaataggaaagaaaaatggtacaatataatttaaaagccaaaaatataattacatctgcattaggcattggatgaatattttagagtatcaaacttcaagaatgcgaaagaaatgtgggataccttacaagtaacccatgaaggaacaacatatgtaaaaaggtctagaataaataccctaacccatgaatatgaattgtttagaatgaatcaaaatgaaactatacaggatatgtaaaagagattcacacacatagtaaatcatcttgcatcattaggaaagatatttcccaataaggatcttattaacaaagttctaagatgtttaagcaggaaatggcaaccaaaggtaatggctattacagaatcaagagatcttattaacatgtctcttgcaactttgtttggaaaacttcaggaacacgaaatggaactcatgagactaaatcaacatgaggaaaatggcaagaaaaagaaaggaattgcacttaaagcttcatcttcaattcaagaaggaggtgataaagaagatttgaatgaaatagaggaagatgaggattttagtttcttcgtaaagaggttcaataaatttttaagaaacaaaggaaataaaaaaagatcaaatttcaaaccaaaaaaaaagaggagaagattcaccctctcttccaaagtgttatgaatgtaatcaacgaggacatctgagagttgatttcccaagtttcaagaaaagaatagaaagatctgaaaagaaaaccttcaatgataagaaagcaaagaaggcttacatcacttgggaagacaacgatatggattcatccaaagactcaaaaaatgaagttgtgaatctaagtctgatggtaaaaaattatgaaagcgatgaagaggtaacatcttctaacaataacttatctatttcctttgatgaacttcaagatgcattcattgatttacataaaaaatcagtcaaacttgcaaaactagtttcattttctaagaaaactatttcaaaattagaaaaggaagttttaaaattaaatgaagaattagaaaatcttagaactgaagtcaaaactttaaaaccaattggcacaaatcaatcttccaccataaaagtaataaatgatagtaaaaaagcatgtaattgttgtagcaagtttatagaagaaatcaaggatctaaaaaattctctttccaaatttattgttggcaaaaataatctagatattatattaggaaagcaaagatgtgtgtttgatgaggctagattaggatatagacctgataaacaacaaaagttatataaaaaattctttgcatccaatcaaaagaatagttctcctttcttaacttgtttttactgtagaaagaaaggacatggtgcatctacatgctattttaggaaaaataataataatattaaaatgatatgggttccaaaaggatgtttttatcaaaactaacattcaaggatccaagaaagcttgggtacctaagtcataaacatgatcatataggtttctttgaagaagagttggtacatagatagtggatgctctaaacacatgacgggagatgcatcaaagttcactcatatttctcccaagaatagtggacatgagacttatggcgacaacaataaaggtagaatccttggagtcggaaaaataggtatgaattcatctacctccattgaaaatgttatacttgttgatggtcttaagcacagtttactaagtgttaatcaattatgtgataaaggctatctagtatcatttgaatctcataactgtgttgttgaaaacaaacatgatagaaatataaaacatataggctatagattaaataatgtttacatgataaatttaaataaaacattaaatcatgatcaatgttttcttagtaaagatgataatccttggttatggcatagaagaattgcccatataaacatggaacatttaaataaactaatttctaaggatttagttattggtttaccaaaacttaaatttgaaaaagatagattatgtgacgcttgtgaaaaaggaaaacaagtaagggtttccttcaaatcaaagaatattgtgtctacaactcaaccattacaacttttgcatatggatctttttggcccctctagaactatgagttttggaggaaactactatgctcttgttatagttgatgattaatcaagatttacatggacattatttctcactcataaaagaggtgtttttcatgctttcaagaaacttgctaaaattattcaaaataagaaaaatctcaaaattgtatctattaggagtaatcatggaggataatttgaaaataaggattttgaatcattttgtgatgaaaatggcattggacacaatttttctgcacctagaaccccttaacaaaatggagtagttgagaggaaaaatagatctttagaagaaatagtcagaactttgcttaatgatgcaatccttcctaaatatttttgggctgaagttgtaaatactgcatgctatataatgaatagagctttaattagaccaatcttaaagaaaactccatatgaattatataacagaagaaaattgaacatttctcatcttcatgtgtttggatgtaaatgttttgtgctaaacaacgacaaagagaacttaggtaagtttgatgcaaaatttgatgaaggtatattccttggctattccttgcacagtaaaacatttagaatttataacaaaataactatgatcattggataatctatccatgttgcttttgatgaaactaactcaactgtgcctagaaaggatactctagatgatttttcagattctttagaaggtatgcatattcatggtgaagagcacaaaggaaaaggaaagggaaatgatgaaaaatttcaaattgatgaaacaaaaacaagtacaaatcttctaagagagtgaagaacttctagataccatccgcttgacaacataatcggtgacatatctaaaggggtaacaactagacactctctcaaagatgtttgcaataatatggcttttgtttctttgattgaacctaaaaatttaaaagaagccataattgatgaacactggatcatagctatgcaagaagagttaaatcagtttgaaagaaataaagtttgggaattagttgagaaacctgataatcatccagttataggaactaaatggctattcataaacaaattagatgaacatggaataataattaaaaataaggctaggctagtagccaaaggatataatcaagaagaaagaatagattatgaggaaacatatgctccagtagctagattaaaagtcattagaatgttattagcctttgcatccataatggacttcaaactttggatgtgaaaagtgcctttttaaatggtattatccaagaagaagtatatgtggatcaacctcctggctttgaaaactcagaaaagcctaatcatgtctttaaactgaaaaaggctttatatggtttaagcccctagggcttagtatgaacgtctgagtaaattccttttagaaaagggtttttcaagagctaaggttgatactaccctttttattaaaagaaaattgaattatatactcttagtacagatctatgttgatgatatcatttttgggtcaactaatgattctctttgcaaataattctcgcaagatatgcaaaatgaatttgaaatgtcaatgatgggcgagttaaacttttttcttggactacaaatcaagcaaacaaagaatggaatatttattagtcaatcaaaatattgcaaagacctgattcactgatttgggatggaaaatgctaaacacatgactactccaatgagtactgcttgctatctggatatagatgaaatcagtcagtcaatagacataaataaatataaaggtatgatcggatctcttctttatttatctacaagtagacctgatataatgtttagtgtttgtatgtgtgcaagatttcaagcaaatcccaaagaatctcaccttagtgcaattaagagaatcatgagatatctattaggcactattaatctagggttatggtatcctaaaaattctacttataatctaataggatactctgattctgactttgtcagatgcaaaactgatagaaagagcactagtggaacttgtcatttcattggctctactctagtttcatggcatagtaaaaaacataatagtgttgctttatccactgctgacgtggaatatatttcttctggcagtcgttgtgcacaaatactttggatgaaacaacaactttctgactatggattaattcttgatcatattcctatttgatgtgatagtacgagtgcaataaacctatctaaaaatcctattctgcactcgagaaccaagcatattgagattaggcatcatttcttgagagatcatgttcaaaaaggggattgtgtactagaattcgttgacacaaagaatcagttagctgatatctttacaaaacctctccccaaagaaacattctttgttattaaaagagaattaggactcctagatatcaatgacttagataaatagttaatttgtttgtttattattttttcttttggttgttaacttttgattgtccttgctgattgtgtttgcttttgatatttattgttgattaaggtttaatgattatttttgcttgagtttttgagtgtctttgatgattatgtttaatagttatggtgattgttgatttgttgttgatgattatttttgaaattttgattgtctttgatgaatgtgtttgagagtttttatgcttattttgattattttgattgttgattgttgttgatgattgttatactgagtgtgtaagttttttgagtgaaaaatagttagttttaatgaaaaatctatgtttttagggtctggtaatcgattaccactccctgtaattgattaccatagaacatgaccctataatcaattacaatagactgtaatcgattactagagggtttggtcagatataggttacgcttgtaattgattatcatgggctataatcaattacagctcgtccctgtctataaatactgcatttttctctctccttgtgcaaccctcttctccctcactctccttgacggcgccccttcctctcaaaacttcaaatcaccataactttctcgtttcttgtccaaatcacttcaaacaaagctcaaatttcttctttttcaattctctacaaactccactgatcataattttcttaagaaagctcaaattgcaaaacccgcaaagaagagaaaggactcatcctccaccaccaccactgcaggccaacactgccacggcacatccggtgacccactagcaccaaaacccccttctttttcatctcccaagtcattgactctattttcttccaatgaccaacttcaaaggtactattcccaattctccaattgtgccattctcgatcctaagtatttagatgtagaattctttgatggggaaacctttgattgctatcaagtgtttcaaaattctgaattagttgagtttatgtctctaaaattaccatattatcctgaattagttagagtcttttacaataatcttaaaattcaggatgaagtcattttttctgaggtgcatcaaatacctattgttgttgatcaatctctattttattctctgactaaactgagcagtcagggtgttccttttgaaggcactctagttgatgattggaagcatgtttattctagtcatgatgctcgtaaaatggtctgtaatgaccatactgatatgaccggtagattgcttgctagctcattcacctttgagtgtcgcatcatgcattatatccttttttgagtcttgcttccccggttcaccaatcttgctcaagcctttaaggaggatttaatcttgctatgggctcttcaaatcggtcgccaaatggattgggcccatcttgttaggtaccaaatgcataaggcattacgagtcaatgcacctcttccatatcctcatcttgtcactttgtttcttcagcatttcaatgttcttttagaggatgaaccttttgttaaggttaaaagatcctttgctattggtgttggtgctattacctccttcggataccagaaggatatggatggccaatgggtgtataaactgtagaagcaagcttcatgatgatgaatcaagttgattcaagatgttttgatgataacaaaagatgatgacaaaaagcccaagagaatgatttcaagattgagtcaacaattcaagaatcaagagaagtttgatttcaagattcaagagaagatgaattcaagattcaagagaagaaatcaagaagacttcacaagggaagtattgaaaagatttttcaaaaaaacaaacatagcacagttttgtttttcaaaagaatttttctcaaattttctaagttaccagagtttttactctctggtaatcgattaccaatttcctgtaatcgattaccagtggcaaagtttgatttcaaaatttttcaactaaatttgcaacgttccaattgatttcagaatggtgcaatcgattacaagattttggtaatcgattaccaatgcatctgaatgttggaattcaaattcaattgtgaagagtcacatcctttcataaaatgctttgtgtaatcgattataaggatttggtaatcgattaccagtgacaagttttgaacaaaaatcaaaagatgtaactctttcaatggttttcagatttttctaaaggttatactctttcaatggttttcctgaccagacttcaagagtctataaaagcaagaccttgatttgcatttgaaataatactgacaacctttacaaacaacttttccacatattcttttacaacctttgaatttctttgaacattttcttgaacttcttcttcttcttcttcctttccaaaagctttctaaagttttctggtttttccaaaccttgaaaatagaagtgtgctatatcttttattctcttctccctttgccaaaaagaattcgacaaggactaaccgcctgaattctttttgggtctctcttctcccttttccaaaagaacgaaggactaaccgcctgaattcttttgtgtctcccttctcccttgtcaaagaattcaaaacgacatagtctgagaattttttttattcttccttttcccttaaacaaaagaattcaaaggactaaccgcctgagatatcttttgtttccccttcacaaagtttcaaagaactaaccgcctgagaactttgtcttaacacattggagggtacatcctttgtggtacaagtagagggtacatctacttgggttgttgtaactgagaataagagagggtacatctcctgtggatcagttcaagtggagggtacatccacttggttgttcaaagagaacaagggagggtacatcccttgtggatctttgcttgtaaaggattttacaaggttgaaaagaaatttcaaggaccgtaggtcgcttggggactggatgtaggcacgggttgttaccgaaccagtataaattcttgtgtttgtcttcttcttccctgcactctttaatttccattgtgcactttaattatcacttttacttttggttaagtttctatttttgttctttactttcttaacattatagtaaaagcctaatcgaatctagtaatattaagaaggatagatttttaattagtaaaggttcactaataattaattcaacccccccccttcttaattattccgagaccacttgatccaacataaacaagacctgccacctcccattctcgatgaacgcacaccctctctaccaccgcaacaagatacctcctcttccttattgaatgacgtcctaattgagttacaggtgttagatcaagtggcctcataataattaagaaggggggttgaattaattattcttaaacctttactaattaaaaatttactcttctaaggcttttacttatgttgttaagagaataaatagtagaagagaaacttaaccaaaagtaaaagcggaaattaaaatgcacagtggaaattaaaagagtagggaagaaggagacaaacacacaagagtttttatactagttccacaacaacccgtgcctacatccaatccccaagcaacctgcggtccttgagatttctttcaaccttgtaaaaatccttttacaagcaaagatccacaagggatgtaccatcccttgttctctttgaacctagtggatgtaccctccactagaactgatccacaagagatgtaccctctcttgttctcagttaaacccaagtagatgtaccctctacttgtaccacaaaggatgtaccctccaatgtgttaagacaaagatctcaggctgttaaacctttgatactttgtgaatggggatacaaaagaattctcaggcggttagtcctttgaacacttttgtataagggaaagggaagaatcaaaaaaattctcagactgtgtcgttttgaattctttgacaagggagaagggagacacaaaagaattcaggcggttagtcctttgttcttttggaaaagggagaagagagacacataaagaattcaggcggttagtccttggcgaattctttttggcaaagggataagagaatgaaaagatgaatagcacaagttttcaaggtttagaaaaccagaaaactttggaaagcttttggcacaaataagaagaagaagttcaaagagattcaaggcttgtaaaggattgtatgaattagtgtattgaaaagaaaatcaaagccttgcttttatagactcttcatgtttggccaagaggaccatttagaagagttataacttttagaaaaacttaaaaccaatttgaaaaagtcaaaaaccttttgaagagttacatcttttgatttattcagaaacaatcactggtaatcgattaccaaatcagtgtaatcgattacacaaggcttttatgtgaaaggatgtgactcttcacatttgaatttgaatttcaacgttcaaaggcactggtaatcgattaccaaaacattgtaatcgattgcagatttttgaaattaattggaacgttgtaaattcaatttgaaaactttttcaaaaacattttgctgctggtaatcgattacaacaatctggtaatcgattaccagagagtaaaaactctttggtaaacatgttttgagaaaaatcatgtgctactcaatttttgaaaaaaaaaattcatacttatcttgattaagccttctcttgattcttgaatcttgatcttgattcttgactctaaactttcttcttaagtcttgaattcttcttgattcttatcttgaactcttgaattgttcttgattcacttgagttgttctttgattgatctttgagctttttgtcatcacctttgtcaccatcttttgttatcatcattgttatcatcaaaatacctttgaatcacctttttgtcatcacctacggattcttagacgtttctagtattataagtccttaattttctagacattttactatttgtgccctgtatttggattttgttatttatcactttggttaattttgtgctttgctttggatatttagcatttggccggtttatgccttgctttgaatattttgcacttgcttctattttatattttgctatggatgattagtttttgttgttggttgtgatgcttgctctagatattttgtggctttgatattttcttctgtctttttcagctttttgatgtttcctaagggtagagaaactaagggtggatcttatctaaaactaggcaataaattgcaaatttaagggggagtaagggtgagtgcatgcattgcaaatcgaatatcgtttatcttgttttcagattgttgtcatcatcaaaaagggggagattgtaagtgcatatgttgtatgaagattttgatgatgccaaaagattaaagctattcaacgttgattcaagtcaagatcaagaaatcaatagaaacaatttacaatagtcctttatatgttaaaagaatctcttaaaaaggttacaaaggtttggccttaaaagacttaagttttcaaatatcttataaagtttttaagtaaatattacatcttgaaaattatgtatttctctctggtaatcgattacagcctgttgtaatcaattaccagaagcaaaaatgtttttcaaaaagctttcagaatcaattaccaatcacaaaagtttttgaaatttaaattgaaaagtcatgattcctcaaaattaattgtttaatcgattaccacatatctgtaattgattaccagtgaggaaatttcaaaaataactttgaaaagtcacaactcttcacaaagttttttgaaaggtcaccaaaggcctataaatatgtgacttgtgttcgaaattcttcagaatttttcagaacattcattgtcctattctctcacaagaaaacctttggccaaacacttgcaaaatcattaaggattcttataagttcttcaagttgtatcattctcttaaagagagaaaaacatcttttgtacttcaaaagcaatttgttgttgtaatcaagaggcagtgggtctcttgatttgtaagttctctgaacacaagggaaggatatccctgggtggttcagaagttgtaaaggaatttacaagtatagtagaaatctcaagtggattacttgaggacaggatgtaggcatagggcatggccgaatcagtataaaactgagtttgcaattctctcttccctaaactcttttactttattgcagtttaatatttactttgcatatttaaagaagcatcaaggaaattgttcattacttctttttttgcatattaagtctacatatttcttttaaagagagaattaaaacttgttaggggaaattttttaaacttaattcacccccctcttaagttattgaggccacttgtataacaagtaaggttgcattttccttataaccacaatttccattaggtctaatgtcaacaacttttacatgaactgttgcaacagatagggaaaattcattcatataaaggatttttttttgtccactttttgctactgacttctttgcgagccacacttggtgttctcaaactaccaaccatcatgtttcaccaactcgttctcacattaaaggagcacatttagtagatttcacagacttcaatgcaccctttgtttttactttctttggaggcaaacttattaaagtggtatccgaaaatgcaagttcatggaccttattctttaatgtcatttttatgctcacatcaagctatgaaaatctctttaccaatgcatcaacctcatttgtgagagttaagtccccccaagaatcacctgcgttgtgtgtaccattgatgaataacatcttccaatgcacatgaatggacaacaagggtattgaaccattgatttggctatacctagcaagtttataggcacacggtaaatcatgaatagttctgagtgtgcagtcacaattaaaactgtcaacactaatggaagcaaagcgcttcaacacaattaaaactttgtgcttcgtagtcttttgtaaaacggtgtattgaacttgtggtcaagcacgttgatgcttttttgaaatgacgccttaagttcagtatgttgcagtataagcatgttattcattgcatcccagcaaatacacaagtctcctatgctatcatgaaacaacctctttagtcttgcttgtgcgccttcaactctgtaaagtagtttaatgtaatatcaatagaagatacataacaaacaaaatgtgaaacaagtaagtaattacaaaaatctacctattagttgtgtttccaagatgcataacacaatcagttcatgcttgtacaaatctctccgtataatgcaacaaccatgtataataaatatactcttgaaaatccacataatgtctacaaatgcttgtaaagctttttaactactactcatatatttgttcatcaatagaattcaccaatcctacccaagcattcatcacaacctcccagtcttctgcattagtcacgagtatcttgcattttgctctgacattcttagaaacatggaattaacataacaagttggttgcaaaaggaaaggcaacctccaatgcattcatcaaagtaagatctttgttagtgacaatcacctgaggcagcatatcatccttcacaaacaatcctttgaccttttttaaatcccattcaaaattcttcatcctctaaaattgtaaataagcaaatgcaaaaaaaaaaatcatttctgttgaagtcacacaacaatctccaatagtggaagatgatatttgttcgtcttccaagtagtatcacaaatcaacattgtgggaatgcatttaatagcttgatgaaatatggatgagactacattatatctttgacaacatcttgagtgtccactcttttgaatcaatatacatattgattgtgctctatcaactttagtagatgttgtaccttcgttcatggacccctcactactagaaaaagcatttttcacatcagttctttagtacatttcatgacggttcaaaaatcatctttgaagtcgccatcatggaaagtcaacactttccacgatagtttttaaacagtcttagcatcttgatttctacatcggttcttttttaaaccatcttagaatgtgtttttttgtcttaaaaatgttttaaaaaaatgatatttctaagacatttttctgaaagaattatcttggaaagtctctaaacaaaccaaaaatttattgaggcttattatttatgaattaattatttaaaaatataatatttctatttggaaacaaaatcattgtttataatatattgaaagtaaaatataaacctaaaattattttatttttatttaaatataattaaaaagttataaatataataaaagattatatgttttgcatatgtgaatctacaaacaatttacaataataataaaggaggtatatgataatttttttatataaaatctacctagttttttcttatcatggaaatgaatgtagtaggatttgaaatatatacattctccacatacatatatatcatgaaatgtgaactacaaagttattatcaatggggttgactacaaaaattgaatgtgaaaaacaaactaaatttttctgaaattaaagttgtcctataaactaagtagtttcaagagaaagatgagagttagcacttaacataatttgtaattaaattatcaccatcaattcaacggtcaagattaatttctaatcgaattgggttcatcaaaataaaccttcaccacctctaacctcttcaattttcaaccaagggtcaataatttcgctgatcaactcgatgcctcttcaatacactactcaaagaggttgattcatcaccgctgggcaatgtagaactaagcatctcagacgaagatcaggatgcctcatcctgtaaccataaacaaattgcaaagattaattaatcaagaatgaaaatatcctctaataaattttttaataatgaagtactcacattgtaagactttcatctacttacaaattataaaagatcattagtatgatttttaaaataattttataaaaatcaataaacttattatcatgtatataataattttttattgaataataatataaaaactttctatcttttctttatctttgaaacaaaatattagcttaatatctaaaagcatattcaaagttaaaataataacaatgtcaaaaatgaaatccttgatagatttataaggtaaagtttattacttagaatagaccattacaccattggtatcactgatttaccgtatcaagaaaatacaacctcccaattgcaagatattatcaaaaaaacaattaataaactaatctaatattctaaaacaattagtccaaacattgccacaaagaatataaattaaaatttgcatagttgcaccatagagcactcacttagtgaaaaccacagaacgagggcgaagtaatctcgaaccttacctagtggaaagaaggcacagatctaaaggagatataaacaaaaagacaaagaagatgaagacacaaagcagattaagaaccttgttacaacccattccacaacacgtttatattttgaaaaaagagaaaatagtatattaattagtttttttcaccttttcaatcataaataataattaaattcattaattttaatcacaataataattaaaaataggttattactttttaattataaatttatgcttagaaaaatagatctcaaataagttagtaggcccttccctacatagcagacattgtggtctgaggggaaaaaaccgtgaggatacaaatcctagaagcctaatataatcaaactaaataagaacaagatttatatttgaagaattttgatccattaaaccacaaggaatcaagtatttaaataagaaagaatgggcaataagcagtcacacaagaaattcccttgaaagtacttctaataatggataagcattgatcaaatggcataacaattttacacataaaacaattatgtttcttaatcaatgacaactactttggggtccacttgttagataaaatgcatccatccatagaaaagggggttataaatttatattataataaaaaaaaatcagcatccttcgttcaacgtttctccaagtcttcctgatctagaagttgaaactctcattcaaatctctggattaacctgaactttgttctttgcaaagtatctcatcctatccctaactatattgtgtaatattcgatagtagaagcatttcaaatgaaaaaaaaggtagacttctttaaatctttcagaaggtagtgattcttttgtccgcaatgcgtattgagaaacacaacaatagtaatggttcaactttcattttaaaggtgaaaaaatatataataaaattaagtttaagcaacttactatgtatataccaatagttatatatgttaatgctagttcataatttcactaattaagagtgacaagaactacattctttaaaactgttgacatcttgcccaatagacatgaataaagcaaattacagatttgaccaatcatatagagaagcacacagacctaaattatgaaaaatgagattgcacacaaaatttgaaagttatctaaaaaataaaaaataaaaaacagaatttatccaaaaatatctagtatgtacaactccttttatccctccactttgtgctaaatagtaaagaggacaaagaagagaattttgagctgattgtgatgcaaattccctacatacctctaatccacgcaatgcaccaaaaatagtatttgcctagaataaataaaatcacaaaaaacttaaaagactaatggccaattagaaatgactatcattaaagaaataaaaagataaaccacatattgcaatttatttgtttttgtccattaaccataagaaaggaagcacaacatcataagagtcttctttatcaatcagtttgtttccctaaaaacaaaacactcaatgaacaagtgtttcaacaaattccaattgctactatgtggcattttagaatggtgttgatggattggttaacttgttcaatgcacagaaaattacgacattaaactaagaaatacatatataaaaggaaactagttttaacttaggaagggaaaagtacaacataaccttcagaatttaagtatccattagccaacaaacaacataatctcattgaatattcaaatccattaacaaacactaccataaaaattatttattacgatgcgccaacaaagatggttgacaaaaatcatctttgaagacaatgtggtgacaatgtcataattaagttcattaataacgaagacgattttcaaataaccatcttggaattgtgaatttaaggatgattattcaaaaaaccgtcgtaattgaacacaatacaaaaatggttttacaaaactgtctttgaatggttttgccttttcaaattcacgctttctctctctctctctctctctctcttatcttatcaggtctctctctcttattctcactttctttctcttgctctctctattgtgaaaccctcatcttcccttcccttctacatttgcaataacaacaaatttaatcatcttctcactgatgagttcgtccctgtcaacaccaatgccgacaagctctacgatgagatgctcaaccttcagaacattgtcgccttcctccatcgcaccaagatcaacgcctccaccgattcctccgtcaccaccggctccgacctctgcaacgtcatcactggcgcccgctagatccctggcgagtcacgcctcaacctcctctagaggaacttctccctctttcatgccatcattgcgcttctcgtccgttactcccccgacaccattctactcatcatttcctaccttgtcgacattctcacctatgtcgcttggaagcttgagctcatgtaggtaatgaactctgagagtgcaaattgattttttttcgcacaaaataagatggtttcctatatactagctttgacataataagtggtattgtggtagactaacatttttttatatattttccattgaatgctcttctcccccattaagcttgttcaaatttctatccattaaaagcagcctcctttaagtagacttttcatcttagtaataggaaatgaaaagtcccattcataatgacatttggaaactattactttttgatttggagattaagattatcttttaaatgttttcttcttcaaacatttcaaatagaacgcaattcccttataacatttatatttttggataagaaaatggacaataataaaataagatgtgtgttgttaatgctattctagctttctggaagctcaaatctatgaattgtttcagatttgatgtttatatagttcatttgtttttttttattttaggcatttggttgaatacattgggttgttcatttctggtgagcatggcttctcttgtttgtctgattatcctgcctgtaatttttggtaagtaatttttttgtcattttgtacaatacaaattatttatttctcaatagcaaatgcttatctacagaatacgaaattgaatactcaggtttattctcctatttcagtacaagggaaaccatcaaaggttgttgttgattcattggctttatttggaaatcgtgagtgccagcacaatgctaaggtagtattttttttttaatgaatcttgagatttttgtcagggttggaatcaaaccccccaaggtatatgacttgagattaatctttcttaaaaggaaaaaagtactaaatatatatgtttctcatatataagggtgttcgtctttatggtataaggatttctagttattttttcataataatcatttcatttatttcttttttctttatgattttgatagatcacttaatatatgtaacttttgtggattttcttgaataaacttgtcactgaggaggcttttgttcctattgctcctagcaacatgtttttctgacccataagttggtgaaatataaatggcctataatgatttgccaatctcaaatgcttctagtgcactggctattctcaatttttttggataattattagtacatgaaaagaatagacaaaaataatggaatttcttttggcataataagggggaattgtcataaatccataaaagaatattgtctggttatgttgaattgctctttttttctttcgtgttgtgttgttttttacttgttaacttgttattgagtttttttttttttttttttgctgtgttgtatgaatgagatcaatgcatgctatgagagatcggattgttattatttttattggtgtgttcagaaacaacaatatttatcaaggtaccaaagtatttttttaccaaattagaaattaacaaagtaattgtgataatagtcattcacatttattgggattgtttacaattgtctattggttgaatcattatttgtagtaaatattagataacacaagtattttaatatatagcttcaaaaggtacaagtggaagtgccaaattgttggaaaggctggtatttgtattattattggctcccatttgctcctttgattataagcacatgcaatgccttaattagcttaattaattatcataattaatgaattaatctagtttcttttgtcgtgaacataaatgatattttgtgtaattatagcttctcttaattaaaatgtaggttgttgtattgaaatggtagaaaattcctatggattgattctttgatgatattgttcttgtcaaagctgtaaacatacatttaacaatacttttttccccatttataaaataagttacctaaattattaccatgttcattcaaaataatttattgggttaagcatttatgtttatcttcaaaaaaactgtggtacatgctcttatcttatgtttaggagatagtatataaattgttaaatagttcactaaatttaaatttaaatagttcactctacctaattagtcagatgtattgtagtactgttaacattaaattgtcttagagtacataataaataaaaaagacaacaattacatgatcattttctgtcttagtttctttcacaaaattcgttggcctttttaatttttctttttaaaaaaagacattctaagatggagaaaaccatcttagaaagtctaccttttaagacggttttttaggaaatcatcttagaatcctcaattttttttatttaaaaaagacatttctaagacggttttcccaaaaactgtcttagaatcctcattttttttaattttttctcaaaaaaaataaaacattctaagacggttttcacgtaaaaacaatcttagaatcttcaattttttttttaaaaaaaaatacattctaagactgttttcacgtgaaaattgtcttagaaagttatgcttctaagacggttaaggaaccgtcatggaaagtgttgactttttatgacattaactttaaagaaggttcaaaaccgtcgttgtatgtctcaaataactatcaccaaagaggcttttctagtaatggaataacaaatagtcatataaaaacaaaccacacctcaattgtgacttccccaacaccagaaagggtttgggctcttcaaacgaacaaattgtagctttcatccactccaagttgaagctgcaacacaagttcccaatctcaaaatcaaaacttcttgaaaacccataaaaggaaaaacaaaaaaaaaacaaaatttaaaaagaaaagagcccacctcctcactgtataagtatatattggccaatggtagatgtggattggaggatgatcggtctaaacccgacccatatagccgatttaagtcggttattggcccaagcaacaacagccccgtctgtcctgatctgtaacgatgtcgtctcattcacttccttagcaaacaaggtcataaaccaccttcgcaactcaagcatacatgtgcagcatggtctctctgacgtggagtttacacgtgtccaggccgagtttgggttcatgttcccgttgaacctccatgttgtcctaaccgccagtcttcccatcggttcgcgattccatgactgacactttggtggcgcgcgactgcacctttctgcgttgttggaccttctgatcgcggtgattttgttctagatcgtgaaaaatgtgttgtggtcgaagtcgtggggtccacggacgtgcaagccggagaaggtgttctgagtggtgtaaaacacattgaagagtgctgctactgattccaatcttcaaccattgctacatttcttccaatccctcagtcgctggaaaccctaaaaaaattgaattgtatgggttattgtgacaaaatcaaagaagagggggagttggagagtgagagggacattgagaaaagactagagggagagacattaaaaacacactcacttctaagatggtttttacaaaatcatcttagaatgaaaaccttttaagatgatttttgcgaaaccatcgtggaatgatagttttcaaaactgtctttgttgaaaaacctcatatttacaaaattttcactttctgactttctaagacggtttttggggaccttcgtcaaaggtgcatcataaaaaactatttttttagtagtgccttttttttcgctgatatctttgtcattcattatatatggtcttgatggtggtgacatttttttttatcttgatctttgttgtcaacaaaagttttttcttcactgcttaaatgactaacctatgcatgttcgaccaatgtttcactaactttctggttatgaacaccacagacaacaaaatgtttccaaccaacttgtttgacaaacttcccttttaatttaaatgaacaaccacatttttttgttctagtactcttgcaaactaacttatccttatcttgcttgtactttccttcattttcactacccactacaacataaattttccttccattttctgacctatgaatgacaagaataaatcgaagacttttccacaaatctcaaacccaaccgaacaaattgtatcaattttcaaaaacctaaaaaataaaatatttttcttcacttaagcaacatacacatacataaatataaaatcaatcgacaactaatctacatatctcatcaattgtgaaatgattggaaaagttagggtaatcaggttagggagaggtcaatgtccaacccattgtcaggatctgtaggcattttatctgattgatctgcaaacattttatttgattgatctgcaagcatttcatttgatagattgagacagtaaaaaacaatttgactatcatcatacatgtttccaaaaccctaaggcattgtaacttcatcagaaaagatgtatttcaatccatgtatacactgcaaagaaccattcatgaaaaatcaaaattacaaaaaataacacataatagaatcatgattttgttgtgtatttgaaatttgacacaaaacaaaatcaagatttcattgtttactaaaatttcagatactaaacttttatcattagcattttcaaatacaacaacttttttatatatacaaaataattgtatatcaaataattttatccacataaattgccgatttaaaaattattaaaatacttttattatctaaacatataatctcgttatgtgtacataataaatgtatgataaaatcttcatatgtaacaacaatctaattaagataatctcctatttgaaaaataatttcttcacatatcaaattttaactttttatatataaaaataaataaataattttttttattgatttgtttctttgtactgtaagtagttattttgtttttagtattgggtcgggtccaatgatgagtggtgaactcccttgattaagtgcagcattccttgacgggcaagaaacagtataaaagggtctgcatgattttgatgttttgatctctctccaaccctaacaccaacttttttaattaattttgttgttgtgaattccatggaagcctccgaagaccaaacagatatcatggagccgcatcttgattattataccctggaagaagatttctcaacaagtttatttgaacttgatgtttttccacatcctaaagatccctaagaatctcacataactttctccgaacttgttgattttctcaactccgcctccaatcgtcaagagggttctcctcaccatcactaaataagtccaaaatggtactgtttttcgtcgactaataatgccttttgtttaaatattttgtgctcttgcaggatttcacattttgtttatcacgggttcttacatggatactatggtgagcaactacggtgttgtccttgctctagtgaagcatctttgggcgctgccacacactactacaaaaaatagcttttacatcggttgatttgggcattctacgatgatttttaattattatcttagaaagtcttcactttttacgacggttccacagaaaatcatcttaaaaaatatcattctaagacggtttttagctaaaaaccgtcttagaatggtatattgtcttagaatgtattttttttaaaaaaatgaaatatattgaggattctaagacggtttttttcaaaaaaaaaaatcatcttagaatgtctctacattctaagacggttctcttaaaaactgtcttagaatgtattttttgtttaaaaaaatattttaaggattctaagacagttatttagagaattatcttagaatgtgtttctttttttaaaaaaaaaaaatctaaaatttcatacattttttaccatcaatcttagatttctattctaaccacatgttatttcatatactttgcatgctaatagatacggaaaaaaaaggaaaaaaaaaggaacaaaaaatattgtcccctaaaacaagcataataggaagtcttaaacaatgtagttataattatgtatgcatgttatctaatgaaattgtatcaaatataaataagcaaggtagaagttataatttgtaatttccttctaggtggaacttcactcacgtgcactaaaagtgattagaaatagtttttgttttgagttaaaaaatttatattaatttttatagcaatttttttagtttaaaagcatctaaatataaattattttacttgaaaataaattttaattaaaatctattttacaaacactcatccaaacataaaatattattagtaaaaaaataagatgttcttagacgtagtgttgtattatgtatgatttttaaattacataattaatataaaaattaataaatttatcatgaaaacttattataaaataactatataattattttatattattaatgtgttaactattttaccttcatattattgtactatctttcatttaatatattatgtggtaaaaaatgttaaattgtattttattcttctttattagttgaaaatataattaaaaaataatatacaaatatcattaatgttgactattatttgcatatataccactgcaaagttggacaagacacacgacacactataatgcatgtgtatcatattaatatacatgaatagctattcacctaatatatattgacgcgatgcattactactaactaggtaccatatcaagcaagagttgacctctctacgaccagacctctatataattttgtaacaatgtttccctttcctacactccaagcgaaactttggattccatcagttttaaggaatcaggtatcttagtccgaagctcaagtatcaaaatacttaaatctatttaaggaattaatttctttcgatatatatttttgatttaaatacatttttcattcttgcaatttaacttttttttatttttgttcttgtaattttcttttcgttttactgtgttgcataatagatacaataccagaatatgtgattatgcaactacattgtaagtatgagcaactaaaggcgtacccgttgtgcagggtttaatctcatcttgacttaggcatataggtttcgtaggacctgcttcatctccacctggtaataaaatccagctataaataagagaaggaaggacacaacagttatgtgatatatagatatggaatgcaatatcctaaggatgatattcgttcatattgggtcatagacatactccttattaatggcacgctcaatgcattgttgtcttcaaaccatctgtgtaactggtcgtttgccttcataaaaaatcaagaccaatatctagatcaaaagaaaatctaaatttttcaactattaaaaataatttagaaactagctaagaaaaatttacttttaattcaacaaaactagcttatcactttttagttactagctaagtttttaactttcaactaaattttaaacttttagttacttttacccaaaataatcatataatataaactaatgtcaatttccatataattcaatgatggttggttttcttaattaaatgtgaagtttatatttgcctattctataaatcaagtagcaatggaaataaccataatgaatgtcaacctagcacaaagaaaatcaagacagaagggaaattatatcaaacataagatgcactccccctcccggtattacaggcatgagaaagtgaagaagaattatttagtaaattggtagaaaaactaaaacaaaaaaaaatatttgaaggctttagagttgtgtcgtgaacaaaaggaagttgctaagtgaaggacttactttaaagagtaaagtgatgagttatttgattgaaaaaatcaattgtcagatcatgattaaatgcatacaaatgtttaataaaatatgtagctatttaaatctctcaagtctcaacctttgattttctaatcaatgggtataactttcactttagtctctaaaggagtaaaatcagaacaaggcaatctgggttggacccacagaatttgagatgagcaaggggaagaggaaaaactagcatcattgatctgaacaagggagaggtggcacgttagctataaacaaaaattgtagcaacaagagacgagatgctcagggaatgacaactctttctcatgatctaaattatcccaaatcattttgtctttccattgcatagtccattttatttcacatacctctctattttcttcctatttttatccttgttcaaaggatgttgtgataaattaacgttaatatataattactctacttcaaaaacataaaaaaaaagagtctaaatcgcacattcctgaacagacatgttgcaccactttattttcaaaaaagaaaagaaaagagagtagccaaaaacaagaaagaatgacatgcaatggtagcataattaattagcagctatggaaatccctctttaagcacttaattttgctagcttaaattatacgttagagaatcaaccaaaaaaaaactcgccttaggaacaccaacatacagatcttctccctctgggtggttgatgatgactccatgtctaggattcaactcgttggtagctatgtcattgtacataaacaccactatgttctcttcttttagtccaccttttatcagcaactagtatgcatggcacacatctgcttgtttataatttaattcaattcatcacaacatccataaacaaaaccattaatgaaaaacacatagcaactcaaaacataaaactaattaattaattttagaaaataaataaaaggagacaccttggtctttaaaccaatccaaaaaaataaaaacaccaaaaccaaattaacttacttgatgcctgtagtttccatagccgtttgaactagccatgagaaccgcccatcgtgttcccacttcatccgagtcagcatccaccggttcagtcggtaactttatgactgagtcccactccttacggttcagcctcgcggctgcaccgtgcactctcacgagcaccaccatcatccataataggacattgtaccacgtcgttttgcttataatggagcgatgaagcgccatatatatcagctgagaaaaacaaatgtgacaccctctaccctcacaaataacgaataaaaggaaataaaatcatgcggatttttttttaaacacattgactttaaattgatttcaaaagataaagggttcacattcacttaatgaaaacatagtagaaattgttcgaataaaaacaacaaagttatcccggctcaaaacaaggtcgtccatgctgaatgaataataataataaaaaaactaaaacagaaaacataacacaactatatcgtttacggaaaatataacatgcgaagtaaaatcctatgccccaatgtcacacttatcagagcatgtctctatcacagactaagtctctccggctctaacatggaatttatcatgtgatggctcacctgaacaaatgacaatcagcccaaacacaaacacacactaggaatgagttatcacattcatatataataaaatattagagcatgtaaaacatataatacttaaagctgaatttatataattaacatcacttcccaaaatcacacacattttgcacatccattcaagttcatccactccagaaaataacatcaaaccacaattgttaactcaatgaaagtcaaacacatgcattatgcaacaaatactctagacttaagcctacatgcaatgtggtaccatttttcagtgaaaaacctcgttgggcgcctaagagtacatgacaggacatgcctcacaatgggtaagttaggtcactttcactaagtgaaatcatagggagaccagtcaggatcacgttgttttgcgagaatgctccaaccatgtgggagcggcacaggcttaaaggagcactcaaatcggatgacccccaaggcctacactccgaagagttcgtcagggcctctccctcctgattcaggtctaacccaaaaaaaaatttgaacacatagactctacctatgaattatgcaatgcacacaactactcaattgtgtgtgtgtgtatatatatatatatatatatatatatatatatatatgtatgtatgtatatttttaaaatatattttaactcagtgcacctcaagtgattaaactcgtcgggttcccacagtggatctcatcacaactctttgcgcattaactcgtcgcccttaaagggtcttacagttgtgtgattacataattcatggctcacaactcaaaacatagaacatctcaacaattatgtaattcacaatccattatgtactaaatgattatcacttacacacagtctcaaccacaatttcataataaaataatttatcgcatctcacgcatcctacacatatcattcaatagtaacatttacttgacacaataaaaatatagattaaccgaatatattaattcaacaaaataaataaataaaaatatctacaacaattaatttgagatgtggcaaaaataattatgattaagcaataattttacaaaagtatttaatttattattatacatatataactaaaaaaataaaaaaataataatgtcacaaaatatttaatttatttctccagagcagtaaaataatacattcacaacaacatttaatttattatatatatatatatatatattaaaagcaaaaaccatgtgttacaagtataatatctttaatgataaacgtattaaatatattattactgcaccttgaagggaatatttaacggctgaaattcatttataagaaatattaacgtatgcatttttttccaccttaaaaagaatgtttatgttgtaatttgttgatcaatttaatatgtagaaaacagtaacatatcaagcatatttgttgcgccctaacgtatcaaagttttctgttgtaattttgttagactatcaaattagtttgttaacaaatttgtcaagaaaaattaaaaatttgaaattaaaaggtgcagtcaaaccattaatttaacaaacatatttttgagactacaaatattttatactaaaatcaatccctagtcaagtcaaataggacaactataaacaatgtataactaatttgttggtttgcattttttttttttgttctttttttcaacaagtattacatacacgtcttacactattttcaaaagagttgtggcaaatttaaagcaacgattcccaaacagggaaaacaactcttatttcaattgaaaacttccaaatataatagtagggaaaaagatgacaataaattgtagttcattacaaacaatagacaatacaattatttgggtcaaatttttcattccaatgataacaattcactaacacattcaaaaaataaaaataaatcacaagcgcaaaacaacgaaaatcatacacgttaatatacaacaagaaatcaagtaataacaattgaaaattaaaaaaatctaatatacaccaagaaaatatcatatcaatatatactaacaggatcatagaatttcataacaatagatattacactcaatttagcgtaagaattattcaatttgaaagaatcatgaattaacattttataaaaacaacccaaaataccccaaaattgatcctctagaaatccttatacatgttcttctaatcctcaagcgtgagtaactcatcccttacctcgatgtagtcgctcaaacgttctccattagcaattgtggcatctctggtgctctctagagctcctcatctggttgttctgatagggttcttgtgcgtcagaaaaagaagaaagaaatagaagtgttttataaaagctgctctaggttaacatttggtttatatagtggaaaattatgacctaattacttttacttatttatttactaatttattaattttattttataggaaaacttaaaaaaaaaaaagcatggttgttacaacaaactcactcagtcactcacacacacaggagtaggtgttgggttgacaaagcagaggagtgaagaaagggtttattaatcaaaattgactcagttaaagacaatatgtcatgcaaatttagagcgcgacacattcaaaatcaaaacagtttgggaaaaatgatgacaaattcaaaaccatttcttaaaatgaacttttatactatgaataaattaatcaaaaacaatactttccaactaaacaatgacttattgtcatttctctacagcttccaagagatgaaaaaagaaccacgacagaagaaacaaattagggatgttagttaccagagagctgagtggttagatctactagaaaagatttaacacccttatcttccgttagcaacatggggaggccatatttcttaactttcacaaagctttcttctggataaactccacggttgtagagattgttgatcaaattcccatattaaaataaggcccaaaataaattaaaaaatgcaggatacaaggatcaaacttgatggcagcatatcctaatttgaaaaaatcaccaaaaaaaagatcaggcaaaagttcacaaaaaatacacaggtatgcaaaaatcaaagaaatcggaggaaagcgagaaaagagaaaaatgatatgaataccgaagaactcactaacgattgttgcggaaccgcaaatagtgattatgtctttggcaactgttcttgcggccatgtcttttctttggagtctaattttgagcaacgaacgtttaagttttcgacatagggttgggtggagcttgttcgcacgatgaagcaaaatgggaaagcttttgtttcgattgtgggaacactggtaagcgaaatgaactggttttgaaaaggggaaaataatggcacttaattagggattggaagtggaaagaataaaacttgatagagaagcaccatatccactaaaaaaggggtatcgatgttgtaagaagttggtgggtctttctacaagtccttgagctccttgaggatgcgctttgaagccatgggagggacgatacgcattcagatctgaaagggaaagagggatctggatatcaggttttggttgtgcagcaccaaaaaccacaatcagtgaaagagggatttgaaagggaaagagggaaagagtgagagtgagaggtctctgtggctctcgcttatggagagtgaaagagcgagtgagggagagcaaatgtttaagctctcaagagggagatataaaaattaaaaacatattctcttcgaagacggttttttaagacggtttttgcaaaaccgttgtggaagggtagtttctaagatcccatatttacaaaattgtcattgcgttacatactaagatggttccttcttgaggaaccgtcatcgttttactatcgtaaaaaatgctttttcgagtagtgacagaccattgagaagcatgaggtggagaacaaatatgcacacatccttgtaattcttgctattaaagtaattaagttctactcatccttttctccctaaatatcttagttaatgctatatattatattgtcattattgaatatataaggggacgaatgcattgaaattgctcttgaatgtactatttctctcacaggactcatccctaaaagggattcaaaattatagtgtaatagattattttatattaatttagtttacttttataactaaattaaaattattatcttattttatgttcattttcttcaaattaagatgtgaggtgtgacttaaaaaatattattatgttagtttttagtttcttttttatttattatctttgtaagggcatactgaatgaatttttagctcactctacaacatatcaatgtgtaattgatatatgatcataaacttaaaatatttattttttaacaaaataagaaacaactaaaaattcaaattataaatgaaaaaactaagcattagtatattaataatgaacaaaaatatgaaatatttaatatgaaatgatatcttgttgatgataaaaaataatgacctaacagaatactttctttgatagacagaacataaaattaaattgttataaatatataagtaaattaaagttataaaggatgtgatgagtttcttatagctttattcgaagttataaaactcaaccggaatggagatagatttaaaaaatataaatcaacctttttaaatgttggggatagttaatttatcatcgactcatcccattgtcatgtttataaatatttatgttatgtaattattttatgaataaattaaatgatagatgataatataagagtaaattgaataaaaacatgcaatatatatatatatatatatatatatatatatatatatatatatatatatatatatatatatatatatatatatatgagtctcattaaacctatgttatttgtataatgtaaaaaaatgtatatttataatcaaactatgtatccactttttatatataatatatctttatattttcaaatacttatatataaaagggtacatattattttttttgttatcggcccatgaaatcttgtgtgcatccaataacatgactagcacacattaattaattaaatgaaaaagtgagatggagagtcttgataattttaagggtgatgtttgaataaataataatacacattactctccaaattaacatataagtgaagaatatgggtgtgttggattaaatacatcaaccatactgcgtgcatgntacgtctctatgtgttttctatttgagtgttcagtagtatataatagtgcggccctcttttataagaaaagattatgggtgtctntgaatctctggtacgagggtccaaaaattgtttaagaataaaatagtttncaagcccgtgtgtttac

What is claimed is:

1. An isolated nucleic acid molecule that encodes a polypeptide that confers disease resistance activity, said nucleic acid molecule is selected from the group consisting of:
    (a) a nucleic acid molecule comprising the nucleotide sequence of SEQ ID NO: 11 or SEQ ID NO: 13;
    (b) a nucleic acid molecule comprising a nucleotide sequence encoding the amino acid sequence of SEQ ID NO: 12 or SEQ ID NO: 13; and
    c) a nucleic acid molecule comprising a nucleotide sequence having at least 95% sequence identity to the nucleotide sequence set forth in (a).

2. A vector comprising the nucleic acid molecule of claim 1.

3. A plant cell having stably incorporated in its genome the nucleic acid molecule of claim 1.

4. The plant cell of claim 3, wherein said plant cell is from a dicot plant.

5. The plant cell of claim 4, wherein said dicot plant is soybean.

6. A plant having stably incorporated into its genome the nucleic acid molecule of claim 1.

7. A method for conferring *phytophthora* disease resistance in a plant comprising:
    1) transforming a plant cell with an isolated nucleic acid molecule operably linked to a promoter that regulates transcription of said nucleic acid molecule in a plant cell; wherein said nucleic acid molecule encodes a polypeptide that confers *phytophthora* disease resistance activity and is selected from the group consisting of:
        (a) a nucleic acid molecule comprising the nucleotide sequence of SEQ ID NO: 11 or SEQ ID NO: 13;
        (b) a nucleic acid molecule comprising a nucleotide sequence encoding the amino acid sequence of SEQ ID NO: 12 or SEQ ID NO: 13; and
        b) a nucleic acid molecule comprising a nucleotide sequence having at least 95% sequence identity to the nucleotide sequence set forth in (a); and
    2) regenerating a plant from the transformed plant cell, thereby conferring *phytophthora* disease resistance in the plant.

8. The method of claim 7, wherein said plant is a dicot.

9. The method of claim 8, wherein said dicot is soybean.

10. The plant of claim 7, wherein said promoter is a constitutive promoter.

11. The plant of claim 7, wherein said promoter is a tissue-preferred promoter.

12. The plant of claim 7, wherein said promoter is an inducible promoter.

13. A DNA construct comprising a nucleic acid molecule encoding a polypeptide which confers resistance to *phytophthora* disease; said polypeptide is selected from the group consisting of:
    (a) a polypeptide comprising the amino acid sequence of SEQ ID NO: 12 or SEQ ID NO: 14;
    (b) a polypeptide encoded by the nucleotide sequence of SEQ ID NO: 11 or SEQ ID NO: 13; and
    (c) a polypeptide comprising an amino acid sequence having at least 95% sequence identity to the sequence set forth in (a).

14. A vector comprising the DNA construct of claim 13.

15. A plant cell having stably incorporated in its genome the DNA construct of claim 13.

16. The plant cell of claim 15, wherein said plant cell is from a dicot plant.

17. The plant cell of claim 16, wherein said dicot plant is soybean.

* * * * *

UNITED STATES PATENT AND TRADEMARK OFFICE
CERTIFICATE OF CORRECTION

PATENT NO. : 7,256,323 B1
APPLICATION NO. : 10/909950
DATED : August 14, 2007
INVENTOR(S) : Madan K. Bhattacharyya It is certified that error appears in the above-identified patent and that said Letters Patent is hereby corrected as shown below:

SEQ LISTING Col. 89/90:
DELETE:
Rps1-k-2_5end 536   CTTTCTACTCTGATCATCTTTTGTTCTTGAGATA
Rps1-k-1_5end 879   CTTTCTACTCTGATCATCTTTTGTTCTTGAGATA
Rps1-k-5_5end1276   CTTTCTACTCTGATCATCTTTTGTTCTTGAGATA
Rps1-k-3_5end 1276  CTTTCTACTCTGATCATCTTTTGTTCTTGAGATA
Rps1-k-4_5end 1685  CTTTCTACTCTGATCATCTTTTGTTCTTGAGATA ADD:
Rps1-k-2_5end 536   CTTTCTACTCTGATCATCTTTTGTTCTTGAGATA
                                            (SEQ ID NO: 161)
Rps1-k-1_5end 879   CTTTCTACTCTGATCATCTTTTGTTCTTGAGATA
                                            (SEQ ID NO: 159)
Rps1-k-5_5end 1276  CTTTCTACTCTGATCATCTTTTGTTCTTGAGATA
                                            (SEQ ID NO: 167)
Rps1-k-3_5end 1276  CTTTCTACTCTGATCATCTTTTGTTCTTGAGATA
                                            (SEQ ID NO: 163)
Rps1-k-4_5end 1685  CTTTCTACTCTGATCATCTTTTGTTCTTGAGATA
                                            (SEQ ID NO: 165)

CLAIM 7, Col. 299, line 50
DELETE:
after or "SEQ ID NO: 13"
ADD:
after or --SEQ ID NO: 14--

UNITED STATES PATENT AND TRADEMARK OFFICE
CERTIFICATE OF CORRECTION

PATENT NO. : 7,256,323 B1
APPLICATION NO. : 10/909950
DATED : August 14, 2007
INVENTOR(S) : Madan K. Bhattacharyya It is certified that error appears in the above-identified patent and that said Letters Patent is hereby corrected as shown below:

<u>CLAIM 13, Col. 300, line 37</u>
DELETE:
after or "SEQ ID NO: 13"
ADD:
after or --SEQ ID NO: 14--

Signed and Sealed this

Twenty-ninth Day of April, 2008

JON W. DUDAS
*Director of the United States Patent and Trademark Office*